United States Patent 12,642,819 (COMPOSITIONS AND METHODS FOR TREATING INFLAMMATORY BOWEL DISEASE) - sequence listing, part 97

SEQ ID NO: 50 - DNA, 4770092 bp, Parabacteroides distasonis (residues 3,180,063-4,770,092 of 4,770,092)
aatcttgtggttctaccggagagactatagaagataaaggataatgcgtactcaatgtaccatcggatttacgggtagcaacagacagtccagccaaaggcaatgctcggtccgaacgattataaagctcgatatactcactcccttccgggtaaggattcggcaacaactcattaaaaacgatctcattgggtaagactataatgtccgtggggatacccggtttatggggagtgtccggacgatccggatcttctggttcatcgtcaggagaagagttcgcggaacccggcgtgcctcctcgctcatccgttgataaataaaaaccgatttcagaacgttcccaagcgataccggctttcgctttctcataggcaatccggtcgatctccttaccggaaggatcgaataacgcaagctccttccccgtgttcgccaaggacgccgggaatttatccaagggcatatcttgtcccgaatcgtcaatatgtatatccctaccagaccgataaagcacgatatatccatccgcttccagagaggcggcggttagttccgtagatttagcgccatataaaaacatccagcctttcaaggaaatcgtctcttcagtcgtattatgtaattccacatattccgtctcgggaaaagcggtttgccctttcggatcagccatcacttcattaatacggatactaccgaaagggagagaaggggtttccggggtttccggaacatcaggaatatctgggtcttcttcatattccaataagatagtagccacatcatccggcatctcattccctttagcgtctttcaagccggaacaagacaaatgatattccactcccagatccagctcctcatcgaaacttatattcacgttcgctttcgtttcatccgcataaacgatacgagaagcctcccccataccggaaatggaaaatacggcatcctcgatattcaccggactatcatatcgcaattgaaaaacagatacggaaaaaggttgaatagcgattagctggggtgagacaggtttctcctccggaacatccggttcggacggcctctccggttccgaagagatttcttgagacacactaacatgagtaaaaccaaaaccattcactcgtgttttggtataacgacattccagacgtaaatcccctcccttacaagaagaagaaaccttagactcgcaactccctatcaagacataaccatcaccatcagattcaagaacatacaaactccaatccttacggtcattcagcgtaagcttaatctgcatagtaacctcttttgtcaaatcttcaagtactttttcgatcaagactttaggctttttctctgtttctacctgtcttcgcagggtaatcgttttcttattgcttccaatctgtatataataatcagctttaagcccagaaatgctctggttatcttgaaatacatggaatcgaacgtgatttcgatcgctgggtataaaatccattccaacacataactcccattgcatagtagccgaataggtaatcggaatctctaaggacacgcttccccgggcaggatccgcacatgagaccagccaaccgttatctatcacaaaacaatccaagtctcctctccaaggattagccgatgttatctccggtccatcaaacggttcttgtaactgggaaaacgcacaaacaggaagtaaaaatgcaagaattaataataattgtttcatagctatatcgttttagttataaatttctctatctttgcacctcaataacttacaactgtaaactaagggggctaaaaggcttaaaatcgaaagcccttttgcgcagcaaagttataactattttacattattcaaattaaatcagtgctcaaaatgaaagtagcaattgttggtgtaagtggagccgtaggacaggagttcctgcgtgtactcgaccagagaaacttcccgatggatgagctggtactttttggctcatctcgtagtgccggacgtgtttatacctttcgtggtaaacagtataccgttaaggaactgaagcataacgacgactttaagggaatcgatgttgcttttgtttcagccggaggtggtacttccaaggaatttgagaagacgatcacgaaacatggtacggtgatgatcgataactccagcgcattccgtatggacgaggatgttccattggtcgtaccggaagtaaacccggaggatgccttgaatcgtcctcgtggagtgatcgctaacccgaattgtaccacgatccagatggttgtagcgttgaaggcgatcgagaacttatctcatatcaagcgtgttcacgtatctacttatcaagctgccagtggagcgggcgctaccgctatggctgagttggtaaaacaatatgagcaattattaaagggcgaggagcctacagtggagaaattcgcttatcaattggcatataacgtaatccctcacgtagacgtattcacggaaaatggctatacgaaagaggagatgaagatgtataacgagacccgtaagatcatgcactcggatatcgaggtgagcgctacttgtgttcgcgtaccggttatgcgcgcgcatagcgaatctacttgggtagagacagagcgtccgatcagcgtggaagaggctcgcaaggctttcgccgaggctgagggtgtggtattgcaggatgaaccggcaaacaaggattatccgatgccgttgttcgtagcggatcacgatccggtttacgtaggccgtatccgtaaggatatcagcaacccgaatggtttgacattctggaccgtgagcgaccagatcaagaaaggcgccgctttgaacgccgtgcagatcgccgagtacttgctaaaggtgggtaatatcaaataacagacaactttgtaaattctatatacgtggaagcgggatcaagagaatactcttatcccgcttttttattccttagcgtaattcctccatgccttctcaaaacgtataaatcaatacgcccaatacccgatggttggttatcgaatgtgtgtcatgaatccgtccgccatcttgcaaatccacatggccataccatgcgatggaagggctatattcaacacctaatttccagtgcggaagattatacgaaagctgcaggttggtcgtaaatacctgatctacgtccagacctacgccataggttttgcctaccagtgcctcattcgctcccaagttcttcaaatagcctaagaacaaacccggtttccatttctttccgtacacgatattcaaccaagaagtagagaaaagatacggtgaatattcctgttcgccggtacgtgggtcgatagaggtgacgccgtaaccacccaacatacaagtctgcgtcaagttagaagccagcaatgttttcgccatcaccaaccaattcgcgtcctgatatttcacgtgcgcctcgccggatacggaagtaacccgctcgctgactttataaatcttgccatccatctcgttctgcgttctcggcactaacgacaagatttccataccggctcctacctgccaaccgggtttcttataatccaccccgagatagacttccggtacgcaactgttcttgatatattcctcactctttccattcggtccggccgatagatattgcaactgccataggaccgacccggtcaattgccacccattgtccgtataacgataacgaatttgcgggctgcggttaaacggttggaacggagcgccggtagaaagattcaacatctgtggaaagacctcgccaaatagcggatgccatgtctgtccgatcaagacagcggacttgccccaatccagattcacataggcatgacggatacggagcaccgcccaattgctacccgaaccccggaaatcggcttccagtttcaaggaagtcttggccgaaccaaccttcggtccttgtacatcgattcccaaacgggagtaaagcaggtaaaaactaccgttcggactagcgttcaagtccttgccatccgcatccaacgccacgtccttcggatataggtggaacaaaccatccacgatctcggcgttcgcacgggaattatagaacaagtctccacgtacctgtccgtaaaatttgtaagagaagtttttcttttgcgcctgtacgcataccgccatacataggccgatcaaaagaagcaagttgcgtttcatttccattccggtcaatctatctttaaaaataatacatcatcaaacctaatatacgatgattcgttatcgcatgtgtttgctcgatacgtccgctctctaagtcggtcgtgccataataagctgtcgccggacaatactcgaaaccgaacttccaatgcggtaaattatacgatacgtttaagctgacggttattaattgatcgatatccaatcccataccatacaccttatccgctgagaccaaggacttcccggttcccaaattcttcgtatatccgacgaaaacacccggtctccatttcgttccataggcgaaattcacccatgtcgtagaatggcgaaaaggcgtatatccctgttcgcccgtacgggagtccaccgagctcaccccgtaaccgcccaataaagcggtatgatccaaggctgaggccatcaaggttttcgccgcaaaggtatagtttcttccgctatacttcaaatgtgcctcgtaagagaatgcggtcattcgctcgttcaccttaaaagtttgctccttccattctgtggaagtacggggtttcaaggagatcatatgagcgccgagccccatcaaccaaccatccgcaggggtaaaatccgcccccacgaacatctccggaatgcaactattcttgatataatcctcgctcatgcctttcggtccgctggaaaggtattgtaattgccacaacacggaagccgtcaattgtacccggctattcgccttatactggtaacggatctgagggctacggttgaaaggctggaacggcgctccggtggaaagattcaagacatccggcatcacggcgccaaacaagggatgccacgtgatccctactaataccgccgattttccccaatccaagtttacgtatgcctgccggatacgtaacatcgtattactaccggaaaaaccgccaaagtccgtctctatcttagcggaggaacgagccttgccgatatcgggacccgtcacgtccaagcccaagcgggaagtgaacgtatagaaactgccattcggcgtggcgttcaaatccttgccatccgcatcaaaactcttatccaaaggatagagataaaagttcccatcgatcggagccatattagcccgggaattgtagaaaagatctccacggacgaagccgtagaatttgtaagtgaagttttttctttgcgctgtcgtagaaaataaggctagcatccccacgagcaacagggtaatccgtctcattataattcagtttgttatttttcttaccttataagccgcgaatgtatatatttttatggattcaatttgaggaaacgaaatattatttgttcctttgcttccaagttgtaagccttaatggtcaaattagattaatattgtaaacaccagataaagaaaatgagtactaaaaagtttttgctagaagaaaaagatatacctacggcatggtataatatcgtagcggatatgaagaacaaaccgctgccgatcttaaatccacaaactaaacagcccttaaaggaggaagatttatatcctctattctcgaaaggcgtctctcatcaagaaatgaacacgacagacgcatggatcgagatccccgatgaagtacgcgagctttataaggtatggcgaccgactccgttggttcgtgccaccggattggagaaagcgctggatacacccgctcatatctatttcaagaacgagagtgtaagcccgatcggttcacataagttgaactccgccttggctcaggcttattattgtaaacaagagggtacgacaaatatcacgaccgagacaggcgccggacaatggggtgccgctctttcttatgcggcaaaagctttcggcttggaacttgccgtttatatggtaaaggttagttaccaccagaaaccctaccgtcgttcgatcatgcagactttcggagcacaagttgttgcctccccaagtatgagtacgaaagccggacgtaagatcttgacagaccatcctaattatcaaggtagtctaggtaccgctatctccgaggcggtagagttggccatgcagacacctaactgtaaatatacattaggtagcgtattaaaccacgttatgctgcatcagaccgttatcggactggaagctgagaaacaaatggaaatggctggcgagtaccctgatgtcgttatcggttgcttcggtggtggttccaacttctccggtatcacattcccattcctgcgccataaactaacggaaggtaaggatatccgggttatagcagcggaaccggcatcttgcccgaaacttacaagagggcaattccaatatgacttcggagatgaggctggctataccccgctaatcccgatgtttacgttgggacataatttctctccagcgaatatccatgcgggaggtttgcgttatcatggcgccggctccatcgtcagccagttgatgaaagacgaattgatgagcgccgtggatatcaagcaattggataccttcaaggccgctactctattcgcgcaagcggaaggaatcataccggccccggaatcatcccacgctatcgccgcagctattcatgaggcagagcaagccaagatcgaaggtaaacctcgtacgatcttgttcaacttatcgggccacggcttgatcgatatggccgcttacgaccaatatctatccggtgatctaacaaactatgaggtaacggatgaggaagtagctaacaatttgaaagatttggagaaaatcatctgataaaaacaagaaaaggggcgataccaaatcgcccctttcccttatttgtctatgaaagtcttaatttaaagtatgtattatgagaaaatttcttcgtaattagtactcgggataatcatgttctggacatttaagctaaagtttttctttttcttatcccacataccgtaatttgtctttatctctccactttgatcatcatattgataagtgatctgatagaatggaacccattcatcgtttgtccgatcccaacgaaacgctttcttctcggaaaccttgccgttctcgttgtactggaactcatatcttacctgtttgttcaacagtccgttttcctgtaagaataccactttagagataatcttaccattctcctcttttgtatcatatagataatctttaggagacgctgcgcttatcgctaaactacacatgaaagtaaaaactagcgcaagaatacttttaccccaaactgatgtcttcatactattttaatttataaggttactatcattttgtaccgcgaagtaaggaagtttcccgacaatcaccaaaagcaaagtgataaatcgttagcaatatcacaatatttaacacattcaagaccttcattcccttcgattcccccatgtttactgacatattgtaaaccaaatcgtaagttcccccgatttttaaatatctattatttaccaccagccggatgtaactttcaaaagaaaactttaaacatcgcttttttaataaattaaaaatctattgattaataaatatatccttacctttgcgaaggtagaatgcaaattgatttcttgacatgcgacaaataatgaaactatttatcacatcctttctttttatcctattctcaggatgtacaaaggatgtatatgatccttccgataaaattccgggagaaggtactaatccattctcaaaggtaacaatttcctctaatttcgattggtcgatgatacaaatatcccaccttaccgtacaatctttcgacccctatgatggcacctataattatctggtagaagtatttgataaaagtccggaagatcaagacgcgaatcttctcgctaccggggtttgctcaaagaaaacgcttttcgataagaaaattatctatccaaagggagagtcggatcaagtttacatacaattgacgacccctaccggatatcaagttaccgctcctgtcaccttaacaccgggtaatgataatgtctgtgatttcgattcgttagccgtatcgcaggaaacaaccgctactccggttagccgtaccccgacccgaagcgtgtcttccacctatacatttataatagaagactctttccctaattacggagattatgattttaatgatgccgtgataaaagtccagatggaaacttccatgaaagacgattatgtacaattcgccaatataaaactgactttccgtgcattaggcggaactaagcgggccggagctttcatccatctccccggcataaagtccaaagacatccaaaaagccgagttaaatggctggaccacgactccagaatcggaaaccgagactccggtttatgccctatcggatgatatacatggattattctcttttcatgaaatgattaatacagataatgaccttccatataggggaaagcaagaacgtttgatcaccttttcgttcgcagccggtgccttaaaagatttgaccattgatgacatcgatcttttcacgaccgtattaaagcgggaaggagaggtcttacgcacggaaatccaccaacgtaattatagctatacccccaaaggggtcagataccgttattactcaaatgataattgcatatgggccttaatgataccggatgatttcaaataccctgtggaacatgcttttattggtgatgcctatccggatctattgaaatgggtaagtggagatagcaaacatgtacaatggtataaaagtaagaatacggttgataagtggatttatacccgagaacaataacaacctaaaatcctccgtaaaatgaaaacgaccgccatcttatttcttgcctatctggctttatgcgttcagtgctcagtgccggaaaacaagagcacgaaaaaagagattagtactcaaccgataaaggtgggtgtattcgatgggcatggaggagcacagacctgtatttgggaaactgtcgccgctatccggctggacccggaaatggaggtatgtaccattactacagcagatatagctaataatgtgctcgattcgatcgacgctattattatcccgggaggaagtggcaaaagtcagtacttaaacctagggaccttaaatcaacaacgtatcaaggacttcatctctaaaggtaaaggggctgtcgggatctgtgccggagcctatctattctcgaatactcccgattacacctgtatacagctaaatggacagcaagcgatcgacatcgagcatgacaaccgagggcatggattagcgaaattcaccttatgcgaggagggtaagaagatattccccgaattagccgaccgcgatacgagtttcgtcatttactatgagggaccggtatttataaacaatccggctgatacgatccaaagcaacacgcttgccatcatggaaagcgatgtgcatgaggaaggaaacgccccggctaatatgacaaacggtaagccattcttcgtagccaataactacgggaaagggcgtgtttttagttccatcgcccaccccgaaggtactcccggcatgatgtggatgatcccccggatggtacgttggaccttgaataagccttttatcccttatcaatcctccgccgtacgtccagacctgttcaatcatgaatcattaatggctaccgatgatttaaagcaggaagaaaaagcctttcaaatccttttaagcggagaaagcgagcaaaaggttgccgccttggattggctggaagcacaccattcatgggacgccaaacgatgggtacaaggattgctttatgacgcttcacccgccgtccgtatccgggcagcccggtatatagcggatacccattacttacctttcttacccaacttacaggcggcctaccggacagaaaccgataaggcgacccaagaagagttaaagacgcagctggagaaactaacagccctacttccttaggctagggagatttaaactctccctagatattcatctaccgtatagtttaagaaacgattgaatggtaataacaatttaaagtcatccaccgccttatccatccaattcttagcgtaaaagaaattatccggcttataagacaccacgctgaaatccttatgcttcatgatataaccataaggggaatccattggatagccggcaggcatgcgtttcagcatctccccctctaacaccggaaatgttttcttaaatgtaggttcctcgataatagccgtaaattcctcgatatgatcgtatatatcctgacgaagtttctttaatagcgcaggtggcgggcaccatacaccaccggaaagcaagcaacctcccggctccagatggatataataaccaccccgttcgctggcacgaccaccttgggagatgtaagcggcgaaatgacatttataaggagtcttatccggagagaaacggatatccctgtatatccggaacaaacaatctttcgcctccaacccggctacctcgggatcgaataaagagatacgaccgattaaatcctgtacctcatcgataaaaaccttacgtagcgcatcgtaacgatttttattgtcttggaaccattcccgattgttatggctcctcaactctgtcaagaactctatgatctgttcattcataactttctatttttaatccttacaaatgtaagaaatattagaaactgtaacccagattcagataaaattgcaggttattattccggttcgacaatccaaagttcgtattcatcggaccgactatactgttataagcataaccgatgctacctccccaaacgctttctcccttgaagagatcgaagaaattattctcatggatcgcataattagcgatcaaagagatataatgccgttgcccgatacgctgacgcaagtttaagcggacaatcgccacggaattatcgaatatctccatatggttgatcccagcgaaagggagttgctggggaagataccgttccggcatatcgcctcccaccacattcaaaaagggataagccggatctttcccgatcaacacacgcccatcgatggaaggtaacaggctcaaatgggaagtcagcggcaataccgacaggaagctgagcttcaaggcggagaagaatgtatgtcctttataggtcacgaagttatccgtataaatggaataatccgcttgcagagaaacgcctttactcgggaagtaacgacgatccaacgtctccagatgggcttgagcgaaatagctgataaagccttccggttttacttgatacttttggttttccgccgtataaaggaatgagttataatcgaaatactcataacgggctcctagcttcaacttgaaattcagccagttcatatccgaatacccgagttccacgaaatgatggcgatacgtcgtatttacgatcttatctcccctgttatacacgtcgaggtcatggtacgtgaacatgtaagacaggttaatattacgcaatggattacgctctatcgcatagtccacccgcccatacatacgtttcccgatcctcccggttacggagaacttcgaatggtaacgggcccgattgtcaaaagtcacattcagcaatagggcgacgatatcctcgctattgaaattcaggcccacattaatcgcgctatttgatttttcctgtaccgtaagcaccaaatcctcctgcctctcgccgactaatttatagcttacattcgagtaaaggtttgtaccgatcacaatagacatggcttcctgcaatttcttcacggtaagcaagctattctctttcaagccgctgatttgcgtcaaccatttctcatcacgaggatctataccttcaaacaagacacgccggatatgaaacgtatcggtaggggctaccggataggaatgtactaatctctttcggtgcatatccgaactatcggataaaccaatcttcttctttaaggcaagaatctcatcccattgcttgcgggcgacttgctcaccccggtcaatcaaggtatccaaggccgtctccccaaaactagcggaattataagggtctgtattcgggcggaacaacagatcggtctgttccttattcggtccgtatttctcataaccatgcaaggcgacgatctgccctacgatatcccaaggggtatttatccgctccaactgtttcaagtcgctagtacccagatctacgccaataataatatccgcccccatatcccgtgcgacatccgccggatagttattcttgatcccaccatctaccaacaccatgctatccaaacgtaccggtgcgaacacggcaggaatcgccatactggcacgcatagccaacggaagacttccatgatggaaaacatattcttggccgtccaccacattcaacgccacacaagcgaaaggtatattcaattgattgaagtccacggaatcatgatagccgatcgttagattcgagaacaggttctggagattttgcccttttatcatcccttggatcgctatctcttttttactccgcccaaaagggagtgagaatacataacgctcggaattctctttctccggaaaagtaaggctactacgtttcacccggtcgctcaataacatactccagtcctgcaatctcaccatgctatcgatttccgcagcattatatccaacggaatataagccccccacgatagctcccatactagtgccggcaatataatcaatcgggatgccggcctcctccaataccttcaacaccccgatatgagcgacacctttcgccccaccgcctcccagcaccaagccaacctttttccgctcagccatcacagaaggcaccaacatcaacccaaccaaccacaataaaaggaacttcctcatctagatattctttccggcaaatgtagctggtttactcgaaaacgcaaacggattcatctagaataaaacgtatgtttacctatatataaagtttatcgctatctcatctattctataaaccatgccgtgaactgtataaaccaaggcgtggtctgcacattccacggcgtggtttatacagttcacggcgctgatttaagaataaatacttattcgctatggaatgtataggttatcggagaactatttcaacaggagaggaacattttatttccggaacataagtgggcaatagatagtatttgatacagtctccctagaattaataggcatttctctctaaaatcgatttacgtattatgaatcaggtatgtacgtgtttatcaaaaaataatatagccatcaacttacttttttccagcaaggtagcagccggagcaatatattactttttctttttcagcagcatgaccacaggattcgactcctcactcaagtttgcggcgatctccttcaactttccttttagctggcctttctcgtaagcctcaactaagtccggggcatctagagtttggcagatagctatttcggggtttcttggctctgatgttagagagacttcttccttattgatgaaatcatcattgtatagaatatagctgaataaggcattttcttgtttatcatacaccagatcttcaccaaggaaacctttaaacgtcgtaaagtcaacctcttttctcatggttctcataaaacagtagcgatcggtgataacggttggaaaaagaaatactttcgtatccatggaggatatggaagggcttcttacgataaaaggactcagattaccatccggcaagtaatggaatatggtatcagacgatgtattgacaagtatccatttatcccgatccgggaacgtaagataaaattccggcgtaatgacaaactccccttctgtcacaaccggagtctcaatacccttagagggaatctggatctcatgggtgatacggccatcttgtttggaaataatcaaatggcactcccgcttgcctttttccgatggataactcttatagcaaatcaaatgatcacgatcataattaaatatataattataataactggtatccgtgaacttaaaactccttttatagtttcccaataagtcatagacacctatttttctcgccggattatccttgacgaatatctcatcgttatcctcatccaagacaagccctgtaagctgcgtgtattcctcaccgctttgccctaaacggtttatcttcctaagtccctttccgtttttatcgaaaacaagaatctccccatcactgccccgattcgtcaccagcatgatatcctttccgatcgctttcacggcacctttagttataaaatcatccgtggtttccaacgcaatgtattccacgtccataagatcttgaagtatcaattccttttccggataatcggccatgacatcaacccttataaggttatcgacagaggaagcggaccgattgccacatcccatacatccgactaaagcgagtagcatagccactgcgttcgtagttaattttctcattttttatgatgtttaaagtctttcgttcaatgtcatttcttgctctttagcattttctcccggtccatcattcgtatcatctcttttacctcatcggatgtctccggcagttgttggatcagagattggagttcatctatagaaagctggcttttccgattatctggagccagcatggtttgctccgtgataccccgtttggacatatccgaatttaatgactccaagaaaggccgggtaaaagtcaagttactcagatccgactcgtttttcaacagttcctttgcgtaagtcacttgagcgaatacacctctctgtagctcctccgcattcttgaatccggagatatccggatggctatataggttcgcgatctcacgaagcaattctacacgagtacccttcaccttccacgcccgataaagcagacgggccgcctcctctatcttacccgagcttctggcgctcatggcacgaatctccatgaccatctccgattcctccggcaattgattgatcaagttacgcaaatccacgatagagatcttgctctttttcccatccgggtctatcatagtctcctccgccacattacggaaaaacatatcctcatagaaggattgcagaagcgcccggctaaacaccatcgtcctctcgtccgcttttttctttaagctctcattcatataaagtaccaagataaaaagccctcgctgacgatcctcttcgctctggaatttagacacgtcaatctcactatacatatgcgagatcgccgcaaggaaatccagtcgttccggattcttcttccatgcctcatagtagagacgggacgcttccttgtatctcccgtctttttggtaagtctccgcacggaaggccaataattgatttaccaagaaacgattgggctccaatcccttttccgcccggtcaaataagtcgtaagcccgtttccggtcatacgtcttacccaaggcggaacccaataagaggcatacctcgaccgaggtcgtatcctgctcataagccatatccagaatatctaccgagggcatatacagaccggcataatacttcgaggctcccccatatttcaaggtaaggtaagtagaatcaccatcagccaacaaaccagagtaaatggaatcagcctgagcgaattgttttgccatatacaaacccaaagctttactgcgtaataactggcgattccccggattgtagatcaaggcggtatcgcaaatcgctaccccttctaatatatagtccggactaccgacacccatacgatataatgtatttaccaaagcacccgccagtcccgcattctcccggttcaagttatacgcttgaaaataggcgatcgtcgcggacgggtattgctccagccgggaataacaatcgccgatcgcacggtataaggccgtattgtcctcattccgggcttgtagtttctcatacgtatcaaccgccctctcatattcgcccaactggaaatacaaccgggccaattgataattagcatagaagtttaggctatcggccgctaataccttgtggaaataccgctcagcgtctttcgccttgcccaagttcgtagccgttcgggccaacgtatttaaaatatccagattagtcgtgtccatggagaggcaaagacgataatagtcgtaggcttgccggtaacgaagcatcccctcgtaggcttgcccgatagcattcatcacctcataatcggaagaatcagccggggtaaggctatcggcacgggcgatcacagccgcatattgcttacggttcaccaagtcttgccaattaaactcttgagcattcccgggaaaaataaggcaacaaagtaacagaactgtaactaaattacatttcgcattcatatctgtatatttttaagattactgattaagcgactaacatagcctctattcttatttcactgtaaccggaaagtaataggcaccgtatataagacacggaccgcctttccgtcctgacgaccgggagtccaccggggcatcattccgatgactcgcaaagcttccgcatccaaggagggatctatcccccgtatgattttaggttccacgatatttcctttcttatctaccacaaacgaacagatcacacgaccttgcactcccgcttcctgcgcatccgtcggatactttatgctttgagcgataaactttaataattcatgatcccctccgggatattgcggcatcacgtccactaccgtcaaagtctcttccttcgtttcttctaccggacttttcaaacggaacgtaatcggtaccgtatatttcacggcgaccgcctttccacgttgcattcccggattccagcgaggcatagtgtttattacccttacggcctcctcattcaataaaggagtcactccccgaagcacctccggattattgacggaaccatcacgcccgacgataaacgagcagattacacgaccttgctccccgttatcctgactctctttcggatactttatattcgtggctatgtatttcaacaactccgcatccccacccgggaaactaggcatcttctctaccacggtaaatacttgctcgttcatctcacgggatttggaagataaggacaaatgggtattatttgtcatatcagcagccaagacctcttgagactcccttccttgatagctgcatcgcaaaatcgcattcgcagggacctccaaagagaaagcccctttcctatccgtgatagtcccctctttaccgcccttcaccacaactgatgccccgatcaaaggctgcccggtctcatcaaccagaatgcccgtagccgtcaccatagcgttcgagaccgtagcctcattcgccagacggacagtcaaacgggctaccgcctcgatattacttaacagcatcaagatccctaccaatggaataaatatcagatatttcgtacgtacgatacccgggctccgcttcttgttcatcatcataatccggttcttcagatgcagcacattgaaactattatacaaagtagtaacggactgatgatgagccaatcccaataaatggtattgatagctcttactatcgtaaccggactggatcaccgtgttatccgccagatactccagattatgcctaacctcacgcttcaataaccatacaaaaggattgaaccaacaagccatacacatcatctcgctcaagatcacgtcaatcgagtgccattgggatacgtgcgtacattcatgtgtcaatatctcatccgtttccttatccgaatgactctccggatgcaagaagaccatacggaaaaaggagaatggcccggcggccttccgcaacgcataaaccggagttttatgaataacaacacgctcactggtatgagccaaccataagatactgcttaattgcacgagaaaacgtccgcataagaacgctacgatcccccaataaataaaccccaaagatcccagcaaccatccataccaatccacggacgccgcggcatccgctttcgccgtcgcctcaggcaacatagcggaatacatataaatcacgtccgctataggctcttgttgccttacccaatcttggatgttcagcaaaggataaaacagagccaagccaaagaacgccagcaagatcgcacgacgtagcttgaagaacgtgtccttatagaagaacaaccggtagaaggcgtaaaagagtacaaaggctacatttaccttcaataagtaggcaaattccggtgtcatggtatgtgggatttaggttattcttttcctttctcaatcaaatcgatgatatcctttaaatcatccgtagagattttctgatctttcgcaaagaaagaaaccatttctttatacgagttagcgaaataattcgttaccacgccgccaaggaacgtacgtttatattccgtttcctctatcaaaggacggtattcatacgtatttccataacgtttcgccttcacgtacttctttcgctccagattcttgatcacggaagcgagcgtcgtataaggaggtttcgggtcctcgtatttggccagcacatctttcacaaaacaaggaccgatccgccaaatccagcgcatcgcctcttcttcctgcatcgttagcttctccataaatcttatccttttatttaatgtatatccacaaagctacgaaatagtcgtaaacggcatgcggaaggcacgttaattaacattaaataagaatcacaagacctgcaatcgtgaattattgcaacttaaatgtgatcggcaccgtatatttcacggctaccggctcgcctttttgggtgcccggtgtccaacgaggcatcatttgcaagacccgaaccgcctcttggtctaatgccggggagattcctctaaggaccttgtaattcgtaagcgttccatccttcgttaccacaaacgaacaaatcacacggccttgctcccctttctcttggctctcttgtggatactttacattcttggctataaatttcaaaagctccgcatcaccgccgggaaacttcggcatcacctctaccaccctaaatacctgctctccattttccagcgtatcttcgtcctccgcttccacctgtacttgctcttgtttttctgcctttgttacatctgtcggaacactttcttctttttgttccgaagactgtccgcatcctacgcacatcgccaaagcgaacaggatgatcattgtgttcataatcgcctttttcattttcaatcagttttaatgttatttataccgttattacacatacttaccaacctctaagcatatccggatattacgttggtttcgcaaatatacgaaatactcgtaatataaatataaacaatacgttaattaacactaatagccatcaaaggcatagaaaagataaaagaacacgattatttaccgaacagttaaaatacacaatatgcccactttgcacgtaaatattagtatatggctgatatctacgcagttatacatacacgcctattaccgatccaattactatctataataaatcagattactatcaatagtaaatcagattttctatagatagtaaccatgaatactatagcttctatcgctagattattacaagaagtacaaccgagcgatacatatcgaagtcagataagcgaataaaacacaaaaaccggattgccctcctctccttttaagttcaactcctgcggaatcgtgatcgagcgaagcgatttatataagtttagctcatacggggtcactacttgtaccagctcatcttttatgaccctcccccagaccgggaaattccgataacttctcgtaccctgcatgccatgttgaaggtttgcgtccgccagttcatagatagaacccggcatctcgcatttttccacgagtgtctttcccgtctttttatccacagaggctatataatagccttggttatacaataaacggaaataataatgtgccggaaactcaatcatatcttgcacaaagatatccttgggatcctttttttcaattcgcaaattactcatgtccgtaacatccaacgaacgaatcacttccgcatccgagtttttcagatcaaggacacaagccgcactgattcgatccgccgagatactgaagaccgtatcattgctatcggtcttaaacaacacggagttttgcgcatcagaataagcgggggcgatacttgtcgtgaacccgctcttctcatgaggtaataaaaaggaataaaaatcattcttgatcgctatcgtatcccctttcctcgaaaataggcctaatccgaatccccctccgttgaaaggctgaaaagggaatgatatggcggcgaaacgatcctttccgatatgacgcatatagattaccgaatactcatgggtggattgtccgataaattcaccttccaacgtatattcccaaactcgattattactaaataaaaaaaggcggtcattacgttcgtccacttggatacatggcagaataccgctaaattcacccggcccctgcccttcttttaccaacgtccggataaaacgcccttgccgatcgaacaggacgatacggggctcttttacgggaagcacatagatatatcgatctgtcacggcataatcataaactccgtctatcaacgaggcatcatccgtggtcacctctaaagggacaaaagtaacccccttgatctcatcgcctaatcccaatagccccggtttatccatcccccctcttatatccgcggttaaaagagagggcgcttccgttggcgaagaaccgcatgacgcgaaacaagaaacgacaaaaacactatttaaataaaacaagatagaggctaactttacacttttcataaccatgcttttttgcctccaaaaatatcccgcatatctcacaaatcacatgataaatgagaacaaaaatgagaacaaacctgccaaaacagctataaatacataataatcaaaaacttgagataaactccacaaatgtctccgtagaaccttctttcttaaaaatcttccggaatagacgaggacgaagtaccgaactattatatttcaatacccgtgtgatctggttggcgggaacgccgatcttcgtaagcatacagaccttcaactccgtatcggaaatagcaggatatagttttttcagccgtaaggtaaagtcatcataagccttattcaacagcacctccaaaagctcccaatcctcagagacaatcttgccggcatcccgatcgtgaaacttctcatagacctccgatttccgcaagatcgcaacagataataaatgcttactctccttattatgaatcgactcgttacaaatctccagccgttgtttttccaattgtaaggaaaccaacatcaactcttgatccttttcttccttcattttcgtaattctcttttccaaaagggcgatttgccgttcattctcttctttttcttctcgcatacgttgttgctggctagcaatcgagcgtcgcaaggcttcttcccttcgaagagcgttttcctgcgtatttctccatcgccgataaaggaggaagcaaataaatagaattatgccgataataaacgcgtacagataacgctcctgtcccctttgcgatagcatcaattctttcctatacaagtcctcacgaaccggccttacatcataccgggaagtgatctgataaatcgattctctcgctgacagcgatccgatagaatcccgtaacgcctcgtatttcttgacttcctccagtatccggccttgtccggccgtatcattcaagagctgatattgggcactcgcttttctcaaaaaagacatggccttgccatataattcctgctcggcgtacagccttcctatctggttatataaccgtccccaaaattcgtaatcccaattccctccctcatattccaacgcacgtaaatagcattccaaagctagggacggttgatccatatcctcatagactttcccccggtaaaaccacgctttgggaggccagtaacagcctcgtgtcgtcctataataatccgtagcgatagagattatggaatccgatgtatgcctcaatcccgcctcatcccgtgattcggtccataacagacaataacgggctttctctcgaagcgataatccattgatatccgtcactttctctaataacaccaaagcgctgtccggatgatgcggaatcaatttctctacctgccagaacaggttgccatgcttgtcgctcctatacgaaaaaagcacaagaaccaagatcgcgatcgtaaacaataagatcgtaaacttgatccctatagaaaaatgccgtgccccattcaaatccttacgcatataggcaaatgtatataaattattcataaggaaagccttttccttccgcattatttcatgtgtcggggcacatgccctgacctctcccattaatgcagaaatatttctttaatcgtttgcgcgatatatggatttagcatacctttgcgtgataattacatagtttaagtagaaatttctaaatacaattaaataacttaaattattatcttatgtggttacttaattcttctatcgggaagaagctgataatgagcatatcaggtctcttccttgttttgttcttattgttccacctgtcgatgaacgtggctgccgttttctccggagaggcttataacatggtttgttcgctgttgggctctaattggtacgctgtggcagctactctcgtattggccgcaggcgttgtgatccacttcgtgtacgctatcattcttaccttgcaaaaccgtaaggcacgtggtaacgaccgttacgctatcaacgctcgtccgaaaggcgtggaatgggcatctcagaacatgttcgttttgggcttgatcgttatcctgttcatgctgttgcacttcagccagttctggtataagatgatgttcgccgaattgatcggtcatcacgaagtagcattggggtcagctatggtatctccacaagacggagccgcttttatcaactattacttccaaggtaatgccgtgatcaccgttctttatttgatctggtacgtggctttgtggttccacttgactcacggtttctggagcgctatccaaacaatcggttggaataacacgatctggatgaaccgttgggaatgtatctctaagatcgtagctacggttatttgcggacttttcgcaatcattactatcatcttcttcctaaacggagtaggtgcttaattgcaagctacaggttttataattaagaacttttgaaattaaatcattatgtctgaaataaattctaaaatacctcaaggcccgttggctgagaagtggactaattataaaaatcaccagaaattggtgaaccccgctaacaagcgtcgtttggatgttatcgtagtcggtacaggtttggctggagcttccgctgccgcatctttggcagagatgggattcaacgtattgaacttctgtatccaagattctccccgccgtgcgcactctatcgccgctcaaggtggtatcaacgccgctaagaactaccagaatgatggtgactctgtttaccgtttgttctacgatacgatcaaaggtggtgactaccgtgctcgtgaggctaacgtttatcgtttggctgaggtttctaactcaatcatcgaccagtgcgtggctcaaggcgttcctttcgctcgcgaatatggtggtttgttggataaccgttcattcggtggcgctcaggtatcacgtacgttctacgcccgtggccagacgggtcagcagcttttgttaggcgcttattcagcgttgagccgtcagatcggtttgggtaaggttaagatgtacactcgtcatgagatgttggatgtagttaaggtagacggtcgtgctcgtggtatcatcgcccgcaacttgattacaggtaagatcgagcgttacgccgctcacgctgtagttgtagctacgggtggttacgttaatacgttcttcttgtcaaccaacgctatggcatctaacggttccgccgcatggcaatgctacaagaaaggcgcttacttcgctaatccttgtatggttcagatccacccgacttgcgttccggtacacggtgattatcagtctaaattgactttgatgtccgagtctttgcgtaatgatggtcgtatctgggttccgaagaaactggaagacgctaaggctttacaggcaggaacaaagaaaggtaaagatatacctgaggcagatcgcgattattatttggagcgtcgttatccggcattcggaaacttggttcctcgcgacgtggcttctcgtgccgctaaagagcgttgcgacgctggcttcggtgttaataacacaggtttggctgtattcttggacttctccgacgctatcaaccgtctgggtaaagaggttgtaaaacagaaatatggtaacttgttcgatatgtacgaagaaatcaccaacgacgatccatacgaaactccgatgatgatctacccggcattgcactattcaatgggtggtctgtgggttgattatgaattgatgacttctatcccgggtctgttcgctatcggtgaggcaaacttctccgatcacggcgcaaaccgtttgggtgcttccgcattgatgcaaggtttggccgatggttacttcgtattaccttatacaatccagaactacttgtcagaccagattcaggttccgcgtttcagcaccgatctgcctgagttcaacgaggcagagaagaatatccaagcccgtatcaataaattgatgagcatcaagggtaaagagtctgttgattctatccacaaacgtttgggacacatcatgtgggaacacatcggtatggctcgtaacgcagagagcttgaaagaggctatccagatgttgaaagacttgaagaaggaattctggagcaacgtattcattccgggtaacgcagatgacttgaacgtagagttggagaaagcgttacgtttggcagactttatcgagatcggtaccttgatggcacatgacgctttagaccgtgctgaatcttgtggtggtcacttccgtgaggagcaccagactgaggaaggcgaggcattacgtcacgatgacaaattcatgtatgtctcttgctgggaatatcagggtgaggataaagaccctgttatgctgaaggaagatttgaactatgaattcgtagttcctcagacacgtaactataagaagtaatcaatcattgcaaaaattagaatcatggataaagatataaatatcacactcaaagtttggcgtcagaaaggtccgaatgtaaaaggacaattcgaaacttaccaacttaaaaacatcaaccaaggcacttctttcttggaaatgttggatatcctgaacgagcaattaatcagcgaaggtaaagaacctgttgtttttgaccatgactgtcgtgaaggaatctgcggtatgtgttcattgtatgtaaacggacatccgcacggaccggcaactggagctacgacttgccagttatacatgcgccgtttcaacgatggtgagaccatcacgatcgaaccgtggcgttccgccggtttcccggtaatccgcgacttgatggtagaccgttacgcttacgataaaatcattcaggctggtggtttcacatccgtaaataccggtggtgtacccgacgcaaacgcaattcctattcctaagccagacgcagagatggcaatggatgccgctgcttgtatcggttgtggcgcttgtgccgccgcttgtaagaacggttcagctatgttgttcgtatccgctaaggttagccagttggctttattacctcaaggtaaggtagaggctgcccgccgtgcgaaagcaatggtcgctaaaatggatgaacttggcttcggtaactgtacgaacacacgcgcttgcgagatggagtgtccgaagaacatctccgttagtaacatcgctcgtttgaaccgtgagttcatttgcgctaagctacaagactaatatttgattagtatatcatggaaaaggcgtctttctctaaaagaaaggcgcctttttatttttgttatatgttgaaaaacataatttagcactacagatcttgacaggaattgaaaagtccgtatatttgcatcgtggttttttcataatagtattagatttaaggttaacaaagtttggttgtcttttcctgatttatctagacactttttttgtttataaacgtaatcagtagacagtagttataaagtaatactgatatagtagtcacttcttttaacttcatactgataacatagacacattacctctgggccgaacagagcccttctgagagattagttgttcggctttgcaaagctatcgtatccatctctttctcgttacttttcacgggttttcttttattccgccacatttttatttgcgtttccttctccccgtgcactatgcccggggttttataaccgacactcatgtgcggtcggcggtagttgtagaagtagatgtagcgctctatcacgctcgcggcacgctcgatggtctcgaacagcccttgcctatagaggcgttccactttaattatcccattgatacgttccgccacggcattgtccgtgggcttgtagtcttccgtcatgctgatggcaatgccatgccgccgaaggcgctccacgtacgcgtcgcaacaatactgcacgccacggtcagagtggtgtatcaggccctccagattttcactccctgtcatctcaacggcctggtctatggcctgccgcaacgcctcaagcgtggctgaggcacgcaagctatcagccagtacccatcccactatcttgtgggaataagcatccgtgaccagatgcaggtaacagacgtctccgccggcaagcggtatataggtaatatcgctaacccacagttgattgggagaggttgggacaaagccctttatcaagttcttccacttatggtaacgatggttggaattggttgtgcccctggctttgcgcggaggaagcatcaggcggtgtcgacgaagcagcgtgtagaagctgtcgcgaccgggcatgaacctctctccgaagagggcggtgagcatgatccacagcttgtaaccaccgataccgggatcctcgccacgtatctcacgtacggtatccagcatgagacgttcattcttcacatggctccctatgtcagccttggactggtaataggcttgacgacaatggccaaacagacggcaggctggcgctactttcatcttgcgaagcctgaccagttccgttactatttggcccaggtttttttctgatgggaatgttaaaatactcttccgcacgcgtgatcattaaatcacgggcctcggtttccaactgggagaaggcaagggccttctccaactccttaacacgcttcttgagttgcgcgttttcatcatggtaatcctctttgcttcgatcgctcatatccgtaggggcttgacacggagccaaagatacctcttttaccactgattcatacttcgccagccatttatttaacaaagttatcccactaataccatgttgtttgcaaaaactggttttgctcatgccggattgataataagaatgaagaagatgcaatttctcttcttcgctgtaatgctcatgttttttgcgcataataattacacattttattgttattgaatgtgtctacctatatcagcataagacatcaatatattgattacaacaatattgaacgccgcggtcggagtggtggatcagtctgtcggcacattaaaaatgtaattattttgaaataatatgcagcgtttatcgttttataagcatctaagcttatatagtcataaaaacaagttagacatgaagccattgattttatctttttttgcggttttattaggatactcattctttttcgataaagatgatgaaataaaattgcgtaatgttgaccagatatcgttggaatctaattctacgatgcctgagaggggtgattctgtcactttgtatgcgaaaaggctccctaatactccggaatatattttacgaatcgcaaaaccggaggattatctcattacgaaataaaattttcgtgttaaaatatttgtttatttgacgaatattgctatgtttgtgcccatgtaacttttaatgcgtgggatatggatttgaaatctactcaatatatagaaaaaacaggaagtgtcgcaaaggcattcctgtttctttttcttctctttctatcaagcatatataatctgtttaagtttgccagccttgaaaatgaggaggaagaagtatcagatatggtgctaccttctaagacttccggtgatgtcgagtatatagaacaagatgacttatctgcaaactgtaaattcctaatcgatagaactactcactggttgggctgagtaagcccttatctgatccgtgcgagtgcatagaaggataagggggacttattttagataattaaacgattttctccaatagattgtattccggtatatcttcgaggaaagcatacgtctgtttctcatagtcaattttgcaacaaaaatgacggatgccgttgcttacggttaagtattttacgtgtaagaccatgttataacgtacgatttgatcgaatacagcgcttgttatctcgatatgtggagctttatattcaataatcattagaggtgctagaaaccgattgtatgcaacggtatcgcatcgcttggatgttctgtttagttttaccgctacttcattcgctaaaagttcttgaggatagtttttttccgtgaccaaatagttcacgaaatgttgtcgtacccattcctctggcgttaatgcgacaaattttcggcgtacaggatcccaaatagaaggctttcctgctttctccgtaactttgactgagaattttggtagatttaatgggagcatttgctatatttgctatttatattctaactaaaatgcacctcaaaggtagttatttatgagaacaaaacaagaaatcgtagaaaattggctgcctcgttataccgagcgaaagctagaagacttcactaagcacatattactcactaactttactaaatatgtcgagatatttgcagatcattttaatgtcccgattttgggattgaaaagttcgatgcccaatgcctcggcagaagggattaccattatcaattttgggatgggaagtgcgaacgctgctacaatcatggatttattatcagcagtcatgcccaaagcggtgcttttcctcggtaaatgtggaggattaaaaagagcgaatgtattaggggattatgtattgccaatagcggcgatccgaggtgagggaacgtcgaatgagtatttaccacctgaggtaccttcattgcccgctttttcaatgcttcgtgccatttcttccgccatacgtgatcatggaaaagattattggacaggtacgatttacacgacaaatcgcagggtttgggaatacgataatgatttcaaggaatatcttcgtagtacgcatgccactggtatcgatatggaaaccgcaaccttgcttactgccggtttcgctaaccaaatacctacgggtgcattgttgatgatatcggataaaccgatggaagaagatggtgtaaaaacagaagcgagtgaccggaaggtaactcaacaatttgtaggagaacaggtaatgttgggagttgaagctcttcaacagattttggatggtaagaaaaccatccgtcatatccgttttagttggtaatagcgaaacctcataatttatggcaaaaaaagaaattactttcgaggagatttgtagggatataacagcaaggaagtttcagcctgtttatgtgttaatgggcgaagagcctttcttcatcgatcaaataacagatttgttattaaaaagcgtattagaggtatctgagagagatttcaatcagattattctatacggcgcagatacagatgctatttctattatcaatgcggcacgtcgttttccgatgatgtccgaatatcaattgatcgttgttcgagaggctcaattagtgagagatatagagttgctgagcagttatgtgaagaatcctttgtcatcaactattttggtcataaattacaaatataagactttagatcgccgtcgtgcgttagcggccgcaaccgataaaaacggtattttatatgagtcaaaaaagattccggattataaaatgccgagttttatcacctctttgatgcaacagcgttctatcggtatcgatccaaaagccgctcaaatgctctcagatttccttggaaacgatttaaaccgtctcaataaggaattggataagctggcaattatcttggctgaaaaggcctcaaaacgcatcacaccggaattgatcgagcaaaatatagggattagtaaagaatacaataactttgagctgataaaggcacttgccatgaaggatatattaaaggctaaccggatcgctcagtattttgagaaaaaccctaaaagtaatccgatacagatgacacttcctgtattatttaactatttctcaaacttgctgatttgttattattcaaaggatcgatcggaatcaggattgatgaccgcacttggtttacggggaacttatcaagtaaaggactatcttttggggatgaaaaattatccagcgatgaaagtttttaatttgatcagcgatatccgaacaactgacgcaagatctaagggagtggaaaactcttcagcgacagatgcagatttactaaaagaattactttacaaaattttacattaaacagaaatcatagacttagtgcaggcaaaagggccttttttcctagaatgatgaaaaagtcaaactggaaaaagaggcctttttgtttatttatcaattaattacgcatattttatctctctgagattttaaaatttattcaatcacgtaccttcttcctcaaaaattccaagaaatccatacttaaagctataatcggtatagctatagattgccttcattatccgttaaaggaaaaatagacaagttggcagtaaaataaatagagtaaaattatgttgtatacaaatataaccgagaaatggatgtttacaatcatatatacaataaaagtatttgagtagattacaaatgttggtagtttttgtaatcattatatagacgttacaaatgtatcatgtttacattactaatataaatcatggattattatatatttctttatccacgtaagatttgctataaattataaataaccagttttttatatagaaatattgattgtttacattaactaaacatgttttttcgtctacaaacgtataaaaaccccctaactatacatcatatgtattattatatttacatatagatcagatatatatgctatttttctaaagtttttctaaatactctatacctccttcttgaacacggtttacagttctacccatcacatatgtatcggtgtgacacatatgtatcaatttagttttataaaaataaattgcacaaatggaaatattgatttatctttgtatccagtttactttatggacatttatcttagtaaacggtcataatggcagtattctagtaagaatttaagatatatatgaatatgagagatcgtattttaaaaataatggaacgtgaaggacttaccccttctaaatttgccgaatcgatcggtatacagcgttcggcaatgtcacatattatatctgggagaaataatccgagtttggatgttctgctaaaaatactggaacggttcacttatgttgattctgactggctattgtttggcaaaggcgaaatgatccgagaacatgtgttaactgaacctaatttgtttacaaatatgcttgaaaatcgtcccaatgtacaagttgttgccgaaaatcgcaaggaaattggggttgagacacctgtaaacatccagaaacaacctgttgtagagcaagttatatgccaagaaaagccttctaaaaatgttagtaaaataatgatattttactccgacaatacgtttgatactttcgtccctgaaaaaaacaagaaagactaaggtaaactgttcggtatatacgttatattcatgtatctttgcggataaattgagtaatcgtgtatatgaagaagtacatcttagacatgaaggtgactgaaaactgtcaccttcataaaaattattgcctgctaaagttaacctcggatgggaatcttccagagatgcttcccggacaatttgtagaggttcatgtagaaaactctcctacaacattcttacgtcgtccgatttccgtcaactatgtagataagtctaaaaatgagttgtggttattgattcaacttgttggtgatggcacgagaaaaatggcagaattccgtcccggtgatattgtaaacataatgctaccactgggtaatagttttacaattccttccaaggaacaggagaacaaaagacttttgctgattggtggtggtgttggaaccgctccgatgttatatctaggagcttgtttaaaagaagccggttttgagcctacttttctacttggggctcgttctaaggatgatgtattgcaattagatgaattccagagatttggtaaggtttatatcacaaccgaagatggttcgctaggcgagaaagggtatgtgactaaccatacgatccttaaagaggttcgatttgaccagatttatacttgtggtcctaaaccaatgatggtggcggtagcgaaatacgcaggtgcggaagctatttcttgtgaggtttctcttgagaacacgatggcttgtggcataggtgcttgtttgtgctgcgtagagaaaaacaaggaaggtcataatgtgtgtgtatgtacagaaggtcccgtatttaatattgagaaattgtcatggctgaattaaatgtaaacattgggaatttaccgttgaaaaatccggtaatgacagcatccggcacgttcggatatggtatagaatatgctgatttcatggatatttcacgtttggggggtattttcgtgaaaggtaccactatccaacctcgtgaaggtaatgattatccaagaatggcggagactccttccggaatgttgaatgctgtggggcttcagaataagggcgccgattatttcgctgagcatatttatccggagatcaaggacatcgatacgaatatgatcgtaaacgtgagtgggtcttcggttgaaacgtatgtcgagtgtgcggaaaagatcgcagagttagataggattcccgctatcgaactgaacatttcttgtccgaacgtaaagcaaggtggtatggctttcggcgttactacgtgtggtgcgggggaggttgttaaggctgttcgtagggtttatccaaagacacttattgtaaaactttctcctaatgtaactgatattacggagatcgctaaagctgttgaagcggagggtgcggattctgtttcgttaattaatacgatgcttggaatggccatcgacgcagagaaacgtaaacctatattatctacaataactggaggtctttccgggccttgcgtaaaacctgtagctctacgtatggtatggcaaacgtatcatgcggtaaagattccaattataggtttgggaggtatttcaaattggaaagatgccgtggagttcatgttagctggggctagtgctatccagatcggaacttataactttgtagatccaactgtttctatcaaggttattgatggattgaatgactattgtgaccgacatggttttaaatcagtaaaagagttgatcggagcattggatattcagagataatctaagttcatttatagactttatttccattttttcaataataaaaaaggatgtgttcgcttacgcaaaaagaacacatcctttctttttattatgaaaaattattcgatctccaatacgaccggacaatgatcagaatgtacggcatcgtttaatatataagcggctttaactttcggcttcatattgtcgctaaccatacaataatcaatacgccatcctttatttttagatctggaattgaagcgataactccaccatgtatattcttgcttatccgggttcaagaagcgaaatgtatccgtaaaacctgcggataagaagcgagtcatccattcccgttcttccggaaggaaaccactgttctttgcgttcctgatcggatcatgaatatctatcggctcgtggcaaatgttgtaatcgccacagagaattaagttcggacgggatttctgtaactcaacgacatatttctggaaatcttccaaccatatcatcttaaaatcctgccgttcatccccactagtcccggaaggatgatagacacttacgatcgatacatccccgaaatccgcacggaggaaacgtccctcattatcatacttctcgatccccattccatactcgatatgatccggttcctgtttcgtaagaatggccacgccactatatcccttcttttgggcactaaacaaataagacttatatcctaaagtctcgaatgtttccgacggaaactggtctggttgtaactttgtctcttggatacataacacgtctggctgttcttgagccaaccattcgggcaagcctttacctacggcagcccttaatccatttgtattgtacgttattattttcaatttttctaagtttagaggtgaatgacttttattctgtctcaaagatacaacttttgacgattttacattgttttcattccataatcggtacatagaaattttctatatttgtataacttagaatgaatgacagactatgctggaacatttgaacgatattttagagaatactcagataacggcctcgaccgccgccgtacgattagctatcagcttcgtgcttggcgctattatcggtgtagaaagacaatttcgccgcagggacgctggtatgcgaacctttaccttgatctgtatgggatccgccgccgccatgttgatatctatttggataccacaaacctatccgaatttcttgaatggagatccggggcgtatcgccgcccaagtccttacaggtattggtttcttgggagcaggagctattattcaaagtcatggaagcgtgcatggactcactacggcggcttgtatttgggtaatggctgtagtaggtttggccgctggtgccggcatgttcttggccgcttctatcactacggcatttaccttgttcgtattggtttctttagaaaggctggagcgacgtatgtatttggatggtgttaataaaatacttacgataaattgctcaacctcgactcccgatcttaaaggtatccggaaaatcttggaaaataggagcatatttatcgtaagtctttcttatgagcataattacgacaagaatacatcgacaattacctataaagtcaatgtgaaatccaagtcctcttacagtgagttattcactgagattcgaaaacttggttacatttcacaaatacgtcttctagcttgacaatgccgtttattcaagttcaccctttagcatatgcccggcgatacgagccgcttcctcaacgtatttaccgcaaggacgtttggcataatactgttgtgtgcgtgcggaaggagcgggattcgtcgatgtctcttccggaggaagaaggctacggcaaatgatcgtcccatgtttctccttgaataaagccgccattttttgtaccatgccatagttgcgggcacgcgcctcttgatctagcggatcaaataccggatacttaaatccggctaacatcgccattgcgtttacggtaccacaaacctcacgcatgcgtccgacacctcctccaaaagatacagacatctttttcgccagttctaaatccaactcgaagacatccgaataagcgaggaatacagattgagcgcaattatatccggactcgaagttgtggaccgcttggttcacacactcctctatatcaaaggatttcatagtcaacacaagctctgtccgcctttaccgggccaataattcctttagcgaccgctacatgttccggatgattagcgtacgtatttacatcttccaaggtaggcaattcagtagttaaaataatatcccaagtctccgccggattacaattaaaatctacacggatcattttcaatacgtctatcttattgattaaggcttccagtttatccttaatttcttgcattttggcttgcttctcagccggagtttgaaactccctcaacttaaacattacaatatgtctgatcataatcgctatacgttaattatatatattacatctgttcatccaaatacgaatccttgtatccaaggaaatataagataccatcgaggccaatcgtagagatagattgcttggcggtcgccttaacctttggtttggcatggaaggcgatacctagaccggcgatactaatcatcggcaagtcgttcgccccgtcgccaaccgctacggtctggcgaatatccacgttctccacttgcgcgatcaggcgtaataactccgctttccgcttcccatctacgatatcacccacatgattacccgttagcttgccattctcgatctcaagctcgttggcgtatacatagtcgatattatatttttgtttaaggaaattaccgaaataagtgaaacctccggaaaggatagcgatcttgaagcccacctttttcaagatacgcatcaagcggtccacaccttcggtgatcggcagattctcggcgatctcctgcatcacggatacgtccaacccctttaataaggcacaacgctggcggaagctctcgcagaaatcgatctctccacgcatggctgcctctgtaatcgcttttacttgatcgccaactccggcacgtatcgccaactcgtcgataacctccgtctctatcaaggtagagtccatatcgaaacaaatcagacggcgcatacggcgatacatgctatcctcttggaaagagatatccatctcaagctccgtggaaagtttcatgaactccgctttcatgcactccttgtttttcggggtaccacgtacggaaaactccacgctcgccttaggagtacgggcattctcgtccaacgggatacgtcccgtgagccgcttgatatcatcaatattcatatcttgctccgctacgatccgggaaacacccgcaatttgcttggccgtaagctttcggcttaatatcgtgatgatataccggttcttgccttgcatacctacccatttactatattcttgctctgtaatgggattgaaacggatattgacgtctaattcgtaactcttgaacagtagttcttttaatatatcgccggaatttccttccgtgctttgaaacaagatacccaatgataaatggttatggatatccgcttgaccgatatcgaggataacagcgttgttcttggctagaatctccgtaagagccgccgttacacccggacgatccgctccattgatatttatcagtattatttcgtcgttttgtgccatatttgtcattctattaggcaaaagtacgtaagaattatcgaaaaagagtacattatattgaacatttttgcttatatttgttttatcgtattaacgacaaaatgtttaatgagaacctggcaaccttaaaaagtcctgaccggcaggcgaaatgtatgagaatccaatttgaaatcaaggaaaagttgcccgacattatttctgaaatacttcattcagataagtggctgactttagtgagagatgagaatcatggattgcgacgtgtgacgattaaagatccctactttgattcagaggcatgcgtcgatatctgggagcatgagattcatgtaacgacagcttggtctaactacacctatcgaatctatcaaaaaggtaattctgtttggtgcgaatacattggcgcttatagaggattgttggaacaaaaccttttgccgacaatgactccgaaagaaaacattctggattcggaagtattgaacagttctttgtttggtgacagaaaggagaccttgagaaattacagcgcggaaaaccttaagctgaagaattttaggcgggataatttcgccgcagaatatcaactggcttctccgcaagaccatcctaagatcgtatatgatgagtttattaaagaaggggttccaattccccctcctgaagatagaaaagaaaagtccggtaattaataccggactttttttatttgaggatcatcgcatgatacccgaatcctcgtcactattccaaagtttcttgttggcctccttgaacttgcggccgaagtcaaaattccaagagaaggttagcatcaacattcggctgaagtcgttcgcgtacatgttcgtacggctgggagcgtaagcgttccgattttcctctacccgtttgtactggctggagaaaggcatcatcaatccggctccaacggcgaatttaccttgattgtaccggaacataaacatatggatattctcgccgccatgcaataattcgccgacaaacgtattatagctactttgtatctggaacatagccatgaatttcttgtacatagccatgacggaagcccggtaataccaattgttataggtatgcgaataactatttccttcgctgatataacgattgactccacctgtcacggataggcttatgatccgcttgatgatagggccgacacgtaatgtcaagtcaccgcttagtttctgccatcctttttggttatcggtaatgcgaatgaacttattattttctcgtatcacttcctccatgatccggtccgggctattactgtaataaaagtttaagtctccggtgaatattccttttttatatagataattggcttgcatgtcataactcttatagggtttcagataaggatttccccggcgtatctgtagcgtatcgatatattgctcgatggcgcttagttccgataggctaggtgagacattatttacgctaccgtttacccggaaatacatattatccgtaaagttatattgtaaggatacctttgggcggaacgtataatattgataatcttcctcaccttcttgcttgagccatgagcgggagacacctattccggcggtataattcaacttcttgacacgtccgctgaattccgtatagagatacgtctccgactgtttcatcttggttcgtcctccaaccgttccgctgtaggtgttatccgtccacgattgggtgtgtttcaatcctcctcccaatcgaccggcctcgaattgccgttcgtagattccctcgccgatgatggaatatttgtctccgtccacgttcgacaagatatccgataagaggatatcgtttttccattcttgatacatttggtttgcgttcgtatgtatgtacgtacctaccatattaagtatcaatgtctgcttatgtggtaaggagtgttggtaataaaggtcgagggaaggacgtttggtagagttgctatttggattccaagcgtatgtcttatcctcgggatggttattggtatacaggttcttatcactacctttatcctcatccgataggaaatagcgtagcgtggcattgaaataataatggtcgttatctaccaaattgtaattaagagagaggttatgggcggtctcagacattcctcttggcagaccttccgaggtacgttccagcgtctcgccattctcaaagcggaaggtctcgactccttccgtccagatatgatacggattccggtaacggacggcgtattgcaatccgaactctgatttcttatgattgaacttcgtcgacacctgatcgtctccaaaagaggtggtcggtgaattactaagatccagattgacagaaccgccgctagtttccctccggacaatgtagtcgagtacgacagaggcgttaccgtaacgtaagcccggattatcatgatattctacccggattacctcctgtggcgataagccccggatatcggacagctccaccttgataccgttgatgcagaattgaatcgtcccttcattcgatagcgatacgctattccggatcgggtccacttccaaacggggaagcatcaaggcgttcaatagattgatgccattgctggaggccgctttttgctcggaggtagggaacgcgatcttacggtccgccgtattacggatagcggaagcgttgaccgtgacttcatctaaggatatagaggaggatgccaatgagatcgtaccgagatctataggctgggaaagtcccagcacggagactaccgaagtcttgtaacctatggaggaaacagatacttgataatctccggccttgactttctcgatccggaaaagtcctttactatccgtcgtcgtccctgtgatgaatgcggaatcggctgtttgaagcgtgatattcgcgaactcaagaggagacttgtcggatagatcgatgactttcccccggatctgtaattgttgtgcccggacaccccaagaaaaggatataagaagggctgccataatgatttgtttcattatagtacgatttaatgattaagaaataatgtgtgtatgtgcttgttacttagtccaaatctcttctccgttcagacggatcttctggatattgttgatacggatatgcaacgtgagatttttatcttgcccggcgtccctcgccccgctaaccaataatagagaatcgtggcggctgacttccggcaaataccgtttctttccctcgtaatagagcagcgaccggtcttttgcttccagtatttgcccccgaggaaattcggaggcggttctcgtatcgacttttatgttttccgctttcaactccggattatctatctggataatctgaaacttttgcgtgaaacctgtaaggcatttttccgacgtaaactgggcaacgccgaaagtgagggctggaacgatatataatgtcgctatcaaggcgataaatacgcgattactttttttcatgattgtctttatttaatggtagatatatataatgtataggctttcgtaagctcgtcgatacctacatctagcaggtgcatctccttgaagacggcgggaagtacctcttccacgaactggttatggcgcatctcacggattttttgctcggcgtcggaagcgacgaagtagccgatcccacgcttgttgtaaataatatcgttggcttgcaggcgctcgaaggaacgcatgaccgtatttggatttacctccatctctaccgccagttcccgtacggacgggatacggctatcggctttgtaattaccactcaatacccggtcgcaaatccgctcggctatctggataaatatggattgattcgtattgtagttcatcttagttccttttctttaagttttagataagcgacgtataagaccacgagggttgcgatgagaaatgcgggtgtaaaggcaaagctcagccaatacacggcggtataaaacggtgaagattcataacaaaaactattcatacccggctggatattcaagatgtttatacatagatagacaatccctatgatagaggctgctatcaatatatatccgccacaagcgattcctaaggcatacttccggaacgtgacataagagagaaacatcaaggagccggcaaacgccagcatggtgaaatcttgcaaggtcatgataatgtccttgaatgctacaggctgtatatgaatgagcattgaggctattcccgtcccagtccagaacgtgacttggtatgttaagaataccacgatgccttcgatcaagatagcggcaaatttctcttggttgctcgcgggaagcgttaagaacaatcctctagggcggtgtatcattaagtttacgtagctacagaaagcgataaaagtccccaatgatcccaatacatataatgtaagggtacggaatctcgtatcccataaaatggaggataacaggaaaaagaagaggactccgaggatgaccaacaccccataagctaatttcttcttattctctatccaatctttgcgaagtaaaagattgatgcgttgtatactgaaatctgttttcatatctatgtgtattttaggagttcatgattctttggatctctttgggataagttatcgctgcgttaaagagcaactctaaggatacggctgtctcttccttgtcctcccgtgcggtgacgcctattgtcccttgcggggtaggctcggaataaagagctttctcttccggcaggagtggtccgaaataaagtttctcgccgatctcgttcaacgtcttattcaataggatttgcctttggtctaagatcaataccgtgtcgatcaagctttccagatccctgacctgatgcgtggagataataaccgtctgattgtcatctatcaaagaggctaccagtctgcggaatgtcgctttcgagggaatgtccagcccatttgtaggctcatccattagaagcaggggcgtatgagcggccagtgccaaggttatcgccacctttttccgttgtccttgagacattttcgacaggcgatcggatagattgatctcaaacgattctacgcaagccttgcagatatcgtctctaaatgtcggataaaaaggtgcgtacatctttatatattctatggcggtgacctcaggcatggagatttcctccggcaataagaagatctgttgcaagaaacgagcgtttctctcggaaggaatttcctccaatacgaggcaagagccttgatccggaaagatctgtccgcttagaaggtttagaagcgtagtctttccttcgccgttctttcccaataagccacagatgtgtcccgatccaacctcaagattgatacgatcaagtacctcttttttgcggctatagctgaatgagagttcttttaatgtaatcatatgttttgctgctttagtgtattagtttaatagtacactgcaaatgtagtggaagtttttgaataaacaagagggaagggtatttttttccttttatttttcaagatggcagtacaaggtgattaaagggaatctcttaatgctattagcctcttttccaagaaggattagcggtttgctcttgaagcattgctaatttttcagttggtgcatgatcatctaacggctgttggaagatcatgcaccaactgttagatgattatgcaacagttgttggataatctatacttaaagatgaaatcgctaaggattccctgttatcggtctaaaggtaggggagcgggaagctaatgattcttgatgattttgcggttctctcggggagaaaaaggtactctacttctaaatttatgttgcaaaacagttaattttttatcgatgtgtgcgctaaaacatataaaaaagcttgctaatttgcagaaaatcgctatataatttggtggaaagaagtatttggttttatatttgcacccgttaaagacaagtaagtgtctctttagcgaaagaaacatgcttgtttacgatcctgaaaatcaggagtcgggagtttgtcccccgggagattcccccgattaagtttaacgtaaaattgaaaatatgaaggtaagagcttatgttctcatcgcatcggtagcgttattagggatgtctgccggttcgaaaaaggcgaaacttaccgagggtgtgaaccccggtgatctagctccgagaatagagtttttgggaaacgacgctaaagccagtttccacaaccaattaggacgttatacattgctcaacttttgggcggcttacgatgcggaatcgcgggctcgtaacgtgcaattggcgaatgaggttaacaagtttggtccggacaaaatcgcgatgtgttcgatctctatggatgagaaagaatctatttttaccgagacggtaaagattgacaagttggatctgtcaacgcaatttcacgaaggactgggtaaagagtcagagttgtacaagaagtatgatttaagaaaaggtttcaagaacttcttgattaacgacgaaggagtgataatcgccgccaacgtcacaccggaaaaactgaccgagattctgaaagcaatttaatcagtattatttagcaaagagggctgttccacttcaagatgggacagccttttttttatcgattcacgagttttcgtttcgagatgatgaaatagcatgtatagtctgagaaggaaatgtacactttctttttaagtccgtgtttattattaactctttttgatttattaaccctaatggatagggtgattgagaaggtcctctgtctttactgtaaatgaacaactaacatcctataaataatgagatctatacttttctttatttgtttgatctttacctttgagggacaggcgcaagaggtagaaaaatcccatatgtggaaagtagaactctccggtgccttgaataataattcagcatgggaggtagagccatctgttacttatctaccgattccttatgtgggaattactatggggttgcttttctgtaatacgattgagaaagatagttatacggggttttcaagagataatcagtggttctgggattcagatgagagtaatccgggctgtcatttctttgcgttacgtccggccatccagttagtaactcccgcttttaaattcgggaaagacaaggatacgggactctctttggtcgtttcacccggattaaccattcctttgcctgtcaatcaagagtttaatataagctatgttccaaacactcccggggtatggatacctcaaaaattcgatcatataaagaacaagggaggtaaatcgttattttatcatattaaaagtatgttgagcctcgatatagaccagcagtatatattctctttggggtatatattctcgaattttgatttatatagtggagggcgaaacttcgttgtagagggaaaaaggcttagtatgcctcggattcgttttatgcattcgttctttctaagtatcggataccgcttttaaatcgtttcatacattgtctttctcgtttagcccaaaaagggagagctgtttttaaggctctcccttttgcataagcttatatataataatgtataggatttatcgaatggcttccacttcttccgtacgcaaagggatcttctttcctaatagacgagcgccgttctcggtaatcagatagtcttcctcgttacgtatgccactgaaatccttatatgtaaacaacttctcgtaattgatgaattcggtgaacttgttctggcctctccataaatccattaattcagggatgaagtatacacccggctcgatggtcaagacaaaacccggttccagcttacgtcccaagcgcaatgacttacgtccgaattccgtactcttcggctgtccgtcataaccaacgtatacctctcccagattctccatatcatgtacatccaatcccatcatatggcctaagccacaaggcataaacatggcgtgagcaccggcttttacggcctccatcggatctcctttcacgaaaccaaggtcctttaaaccctccatgatcactttacaagacaactcatatacatccacgaaaggaatacccgggcgtaaagctgctacggcagcttcatgggcggctacttgaatatcatagatgtctttttgacgggtcgtgaacttagagtcggccgggatggtggatgacatatctccggcatatcccatctcagtctcggcaccggcgtccaataacagcatatcgccgctcttaatcatatgactatgatcatggttgtgcaaggtctgcccattgatcgtggcgatgatagggaaggagagctggtaattgttggcgaaagctacttccgcaacggcagccgctacatccgactcccggattcccggacgtacggtacgcatggcagtcaggtgcatatcggcggttacgatacaagctttctcgatctcggcgatttcttcctcgctcttgtaattccgttggtttacgacacccatgatgaaaggcacggaaggtttctccgcgccgggtacgatacccaaccattggaataacttgatctggtgttccgcacgatatgtcggcagataatggattggctggcctttttgctgggcattcttcaagtaagtctcgatctccttgaaaggacggacttccttgatacctgcggcctcgctcttctcttttagggtgggctgcgtacccatccatacaatcgcgtctatagtcaactcatcgccaaagatgatctccttatcgttatcgatatcgatgatagcggataacccggcgtatggcaatccgaagaaatacaagaaggtagagtcttgacggaagtgatacgtattatcggcgtagttcatcccactctcgtcgtttccaaggaatagcaacaaaccggaacctatggtttgtttcagcttagcccggcgggccatataagtttctttactgaacataaggattattttttgttagtgtaccaaagatagtaattaatgtaatatactaggccgacattcgaaattatttcttacattagcccatgtaaaatgtaacctctggtaccttatgaagattcaaagaattcaagagcttaccgatgcctccatcgtctgtggctcagagaaacgggagaacgatgtgcagtgcgcttttgccagcgatctgatgagtgacgtgcttacgctggattgtggcgatgtgctgttggtgacaggactttgtaatttgcaaacgatccgtaccgcggagatggcggaagtttcttatatacttttcgtgcgggggaagaaagtaaccccggatatgctggagctggctcgtgagaacaatatggttcttctggagacagatcattctatgtatcatacggtcggagagctttatagcgcggggctccttcctatatattaagaaaggaggtcgtgagatatgctatttaagtttgagttggagggcggtaatttcttgaaggcgggttatgcgtctagccagataaagaaggtcttgaagcaattggctatcgatccccggatcattaagcgggtggtcgtggcgctttatgaggcggaggtgaatatcgtggctcacgcttggagaggaacggttgtcgctgaattggacgctgataaaatatctttggaactgaaggatgaagggcccggaatcccggatatatcgctagctatgcgtgaagggtattcgacggcatccgaggccgtgcgtgagatgggatttggtgccggaatgggacttccaaatatgaagaagaacgtagatgaattaacgatcgagagccaagtagacgtaggtaccacggtacgtatggtcacatggtttaataaagaaggagcgtagaccatggaggaagctaatttttatcatgccttgaagattgacaatgaccgctgtataggctgtacgcattgcatgaaagagtgccctacgggagcgatccgtatccgggatggtaaggctttgatccataaggattggtgcgtggattgcggcgagtgcttgaaatcgtgcccgacagaggctatctatgtggagcaggatgacttccagcgtatatttgattataaatgcagggtagcgttgatgcccacggtatttatcgggcagttctcaaagtacacgaccgagaaggaaattatcagcgccgttatggaactgggctttacccatgttttccaagtagagtttaccgccgatatgatccataaggaaatggtacggcagatggaaaacgccgaggaaaaaccggtgatcagttctttttgccccgctatcgtccggttgatacaagtccgtttccctgcgctggtggataatatcttattggtgaaagcgccggtaaacgcctcggccacttattatcataagatattggaagggcaaggtgttccctcggaagagatcggtatcttttatgttacgccttgcgcggcgaaaatcgcggcgttgaagggagcggaaggttattcatctacgatcaaaggcgtgataaatatggataccctatataataaggtataccatattcttaagaatcgcccgagaggatatgagccggaatgtgagcttcctccgccattaacgaaaaaagagatgcgatggagccagacaggaggggaggccaaacatttctccggtcgttgcctcgcgatcgatgagatccataatgtgatcgatttcttggaacgaatggaaacgaccagcgaggtacgtaacgtagactttctggaactgagggcttgcgaccgtagctgtgccggaggtgtattagccgtagcgaaccgtttcctcacggccgagcgtatcatgaagcgatccatgaaccgggataaagtaccgatgatatacgccgccgataatttcgaggctttatcctatttgaggcagcatattacgatccgtccggtgcaaccgaatcccaaacggttgtacgaaggaacgatcgatgagatgctgaagaaaatggagcaagtgcggaaattgatgtgctacctaccgggaatcgattgtggcgcttgcggcagcccgaactgtcaaagcttggccgaggatatcgtacgccacgaggctcaattcagtgattgcgtatttatgcaacgtaatatggagaagcacggtaaactagaccaagagcatgccttccgtatcgttgagaagacatgggggaaagatcgtttaaataaggattgttataagaaaggagctaaatatgaaggtttgtgatttagtgaagatgttgaatcttactgtattttgtggagaagaaggccttgatacagagataaccggaggctatacgagcgatttactaagtgatgtcatggggcatatcgaggagggtatgctatggattaccatgcaaacgcatcagaatatactggccgtggctactttaaaagacgtctccgcagtattgatcgtgaacggaacctctccggatgatgagaccttacaaaaaggtagggaagaggctgtccctcttttaggaactacacgctccgcgttcgaggcttccggtatgatttaccgcttattacagaatgagaatggatgaaacagtatttagctgatttacatatccatacttgcctgtcgccatgcggcagtctggaaatgagtccatcggagatcgtgcgtcgttccttagcgaaaggtttggatgctatcgctattacggaccataatacgaccttacaatgcccggagattcaatcccttggcgagagattcggactaagggtctttgcgggcgtagaagttacgacccgtgaggaagcgcattgtctggtttatttcccgaccgatgaatcccgtaagcgattccaacgatatttagaagagcatctccctccaattccaaatgatccggaacgttttggcgatcaagtttgggtgaatgcggagaatgagattctaggagaagtaccctatcttttgctctccgccttggatcaaagcgtaaaccaaatagccgctcaagcacgtaaggtggatgctctatttgtagccgcccatgtagaacgtccgtcattcagcttgatcagtcaattaggttttatagacccctgcttatctttagatgctattgaatataataatcagcaaagatacagtaagttattgtctattcacgggtatttgaaagagcagactcaatactcagcctcggatgctcattaccccgaacaaataggtactcagccctccatttggcaaacggaggaattaaccttcgatggcttacgaaaggcttttgatcaaaaagacaatcacttaattttcgcctctcatggataatctctcgtttcatatcacggatataaccgctaatagtatcagagcaaaagcttctgatatagagatagatatacagataaaggacacatccatatgtattcgtatcgcggataatggctgtggtatggatccggaaacagtctctctgatccgtaatccgttttatacgactcgcacgacacgaaaagtgggtctaggcttacctttcttgatacaaaacgcggagcaaacaggcgggaatgtggaaatatcttccatacagggaaaaggtacggtagttgttgcttgttttgtctcatctcatattgattgtccgccttggggagatttggcgggtacaatggctatgcttataggcagtaatccggacataaacattcatttctcatatcattcagatctggtttcatttgatatcagtacgcgagagcttaaagaaatcctagaggacatgccattaagtcatccgaaagtcatgctttatttgaaggagttaatagcgaatcaaatagtcgcgtcaagctgaattaatcttttcatataggtgatctgatcttttcacagctgtgatacgatcttttcacatccatgaaacaaacgtttcacagccgtgaaaagatctgtgtctttactcaaagcagctacaagctttgcttgaatgcactaatttatccttatcttgctattaattttataattcccattatgtttaatagtattatgaacgatcaaaaaatgactactccgcgatacatgatacacaaataaaaaaccgcctagtaaccttatattactagacggttccatttattctgaaagaagaaattacttattcatctctgcttcaatagcatcgaatttatcacccatattcaagttgtagtaaatacctcttaaagcggtcatatattctctttcttctggtttcatttggtgagctttctcaaagtaaggaagagctagcttaaagaattccttagctttgcctaattcctcttgatattgttttgcgtcgttgatcatattagcctcaccttgcttgtttacaccttggttgtaatatacacgacctaagttagagagagattcgatatagtcaggattgatcgccaatgctttcttgaaatactcttcagctttagcgtaatctttcaaaccagtctcataaacacggcccattacatcgtaaagctgtggattgttggaatccttagcgatagctgtgttcaaatattcaatagctttctcatttctattagaatagatgtaattgtttataaggctcattaagaaatactgttcctcagggaatttattcaaaccttcttccaaagtcttctctaaattcacggtatctttagcttgctcatactcatagcataagtattgatatacctcgcttgctctataatccgtatttttagcacgctctaacgctgcgatagctttttgagaatcgccaagttgggtcgctgctacagcggcatagaactgaactgtcatgaagtttgaatctctttcagcgacagcctcacctttaaacatcggcatatcagatattttcaggtattgctcgaagaaatcgtaagctttgttataatctttctgatcgaaatagtaagcaccaccattgatgtaatatacgtggtttgctcctaggatacctttgatatctttcgtgaacttaggtttaacttttcctttttcattaggaagttgatctaactcatatgctttctcaaagtatggcaaaatactacccaatgcctcgtacataacaggctcgtccggttgttggcccaagacttgtttagttctttcgttgctgaactgttgatcctcgataaaaccggcaacataccaagttttagcgtcatcctttgtttctggattttccaaagctcctttaataagagttctggcttccgagaaatcaggagttgaacccttagctatactttgagcctcatttacagcttttttctgtgcaaaagagaccgatgctgcgacacatagtgccactgttaataatactcgtttcattgcgatagtaattttgagattaatatttctatttgtttaaaattattcagttatttcttcgttatcattttgttcgttatcctcctctgattccggcagatcaacatcggtacctagactagcttgattctcactcaactctcttccctcattctcttgtctggcttcttgttccgctttttgctcggctatctcctcttcactctcagacaatactttacatacagaagcgatttcgtcgttgcgcttttctagattaatcaaacgaacaccttgagtagcacgtcctattacgttcaaatcggccactttcatacggatagcgatacccgacttattgataatcattaaatcgttctcgtccgtaacattcttgatggcaactaatttgccggtcttctccgtgatattaatggtttttacgcctttaccgccacgattcgttatacgataatcctcgatagaggaacgttttccatatccctgctctgatacgacgagtacggtctctttttccttgtccttgatacagatcataccaacgacttcatcggtattatcctcgtccaaagtcatacctttcactccggaagccgtacggcccattacacgtaccgcgctttcatggaaacggatcgcccggccgttacggttcgctatgatcacctcgttgttgccattcgtcatacatacttggatcaagccatcgtcttcacgcaatgtaatagcgttcacaccgttttgacgaggacgggaataggcctccaacaaggtctttttgatcacacctttcttcgtacagaataataggtaatgagaattaatgaattccgtatcggtggttaatttcttaacacgtataaaggcttgtaccttatcatccggctcgatattcagaagattctggatcgcacgtcctttagcgttcttagctccttccggaatctcgaataccttcaaccaataacatttaccttttgccgtgaagaataataaggtcgcgtgcatggatgccggatagatatactcaacgaaatcctcgtctctagtctcggaacccttcgctcctacaccaccacggccttgcgcacggaactcacttaacggggtacgtttgatatatcccatatgagatacggtaatgatcatctcatcatccgcatagaaatcctccggatttaattcctcagaggcgtaaacgatatccgtcttacgttcgtcgccaaatttatccttgatttccaataattcatctttgataaccttcatacaaaggtcctcattctccagaatctcattcaaataagcgatcaacttctcgatctcctcatattccgcacgcaatttgtcttgttccagacctgtcaactgacgaagtctcatctcgacaatagcacgtgcttgaagctcagataaagagaaacgttcgatcaaacgctcgatagcctcttgcgggctcttggaagacttgataatcgcgattacctcgtctatattatcggaagcgatgatcaagccttccaatatatgagctctctcttccgctttcctcaattcatattttgtacgccggataacgacctcatgacggtgctcaacaaacgccttgattaagtcttttaagttaagcaacctcggacggccgttcaccaaagcgatattattaacgctgaatgaggattgcagagccgtaagcttatataatttattcagtacgacactcgagttcgcgtcacgtttcacgtcaactacgatacgcataccgctacggtcggactcgtcattgacattggaaatgccatcgatacgcttctcgtttaccaggtcagcgatatacttgatcaactcagccttatttaccaaataaggaatctcggtaataataatcttctcatgattattctccacctcaatctcggctttaccgcgaaggatgatacgtcccctacccgtctcgaaagcgtctttcacgcctgcgtagccataaattgtagcgcctgtagggaagtccggagccttgatatattgcattaagccctctacctcgatatctcccttggcatcgatataagcgatacaaccatctaatacctcgctcaagttatgagtcggcatattcgtagccataccaacggcgatacccgatccaccatttacaagtaagttaggaacacgagtcggcaatacggtcggctccttcaacgtatcatcgaagttaagctggaaatctaccgtgtccttatcgatatcccggagcatttcttcggcgagtttactcagtcgtgcctctgtataacgcatagcggcaggactatcaccgtccactgaaccgaagttaccttgtccgtctactaacggataacgcatagaccatgtctgggccatacgaaccatggcgaaatatacagacgagtcgccatgtggatgatatttacctaaaacttcaccaactattctcgcagattttttataaggtttgtcggatgtgttacccagttcattcattccaaataaaatacggcggtgaaccggcttaaagccatccctaacatcaggaagagcacgtgaaacaatgacagacattgaataatcaatgtatgccgatttcatttcctcttcgatgttaatcttaataattctgtcttgatcaaccatttagttttatattaattacactcaatatctcacctctgaaaaattgcactaaggtaaggtttttccgtatactacgaaagaatttgtcttgaaattttgcgcctccgggcttttcaaggcttattaaggaataatggcacgaaatttgatgatagttggaatagattatgtaactttgcgtaatcagtacatatataatatagtatgaaaaattattcgaaaagattgattgacgtgattgagtatagccgtgaagaagcggctaggctccagaatagctatatcgggccggaacatttgatgctaggcatcatccgggaaggcgaaggcgaggcaatgcgtgtcttgcgagagctacataccgatccgatggatattaaacgcaagattgagcaagaaataaagaacacatttgattctgaggattctgtccagcatgagatcgctataagtaagactacagaacgtgtcttgcgtatgagtatgctggaatctcgtttattcaaggaagatgagaccgatacggaacatctcctattggcgatattgaaagaggagtttaatgtagccgccaaggtgttgaacgacgcgggtattacttatcgttccgcatataatatattagtaagcggaaccggtttgaataatatggaggaattcgacgagatcagcgacggatatacggatgatgacgaagatgacgaggacgaaggtttctcctctcgtcgtgaggcatctcgcccctcttccggtactggagcgggagccgctcaaccgaaatcccctaatgatacacctgttctggataacttcggaacggatatgacacgtgctgccgcagaaaaccgtctagacccgattgtgggacgtgagaaggagatcgagcgtttggcccagatattaagccgtaggaagaaaaataatccggtattgattggtgagccgggtgtgggtaagtcggctatcgtagaggggttggctttacgcattattcagcgtaaggtttcccgggtgttattcgataagcgtgtgattagcttagatatggcttctattgtcgccggtacaaaataccgcggacaattcgaggaacgtattaaggctatcttgaatgagttatcgaagaacccgaatatcatcctctttatcgatgagattcataccattgttggcgctggttccgcttccggatctatggatgcggcgaatatgctgaaaccagcgttggctcgtggtgagattcaatgcattggcgctactactttggatgaatatcgtaagaatatcgagaaagacggtgcgttggaacgtcgtttccagaaagtgatcgttgatccgactacggcggaagaaactttgcagatcttgcgtaatatcaaacctcgttatgaggagcaccataacgtgatctatactgaagatgctttacaagcgtgtgtaaaattgacagaaagatatatcagtgaccgtaatttcccggataaggcgatcgatgctttagacgaggccggttcccgtgtacatatatctaatatcattgttccgaaaagtatcgaagagcttgaggcaaagatcgaggatacgaagaatgagaaattagcggccgtgaaatcgcagaactttgaattagccgcaagttttcgcgataaggagcgtcagtatttattgcaattagaggctgcgaaagctaaatgggaacaagagcttcaagaacatcgggagaccgttgatgaagagaaggtcgctgaagttgttgccatgatgtccggtgtacctgttcaacgtatcgctaaggcagagaatgtcaagcttctggaaatggcggacgtattgaaaagtaaggtggtcgggcaggatgatgctgttcaaaagatcgtaaaggcaattcaacgtaaccgtgttggcttgaaagatccgaataagccgatcggaacttttatgttcctaggaccgacgggtgtaggtaaaactcacttggccaagaagcttgctgaatatctatttgattcggcggattctttggtacgtatcgatatgagtgaatacttggagaaattcgctgtttcccgtttgatcggagcgcctcccggatacgttggttacgaggaaggtggccagttaacagagaaagtacgtcgcaagccctattcagtggtcttattggacgagatcgagaaggcgcatccggatgtatttaacttgctgctgcaagtcttggatgaaggccgtttgacggatagtctgggtagacgtattgatttcaagaatacgatcttgatcatgacttccaatattggtacccggcaattgaaagatttcggccgtggcgttggtttcaatacccagatggctggtgagccggataaggatttctcccgtagcgtgatccagaaagcgttgaataaagcatttgctccagagttcttgaaccgtgtggatgatatcattatgttcgatcagcttgataaagccgctattcataagattatcgatattgagttacagggtctgtatcagcgtgtatcaaatctgggctatgagttgtcgatcacagacgaggcaaaagatttcattgcgacaaaaggctacgatatccaattcggtgcccgtccgttgaagcgtgcgatccagaagtatctggaagatgagatggcggagatgattatccgtgcctcagtaggtgaaggcgatacgattatcgtagactttgataaggaagagcagaaaatcacgacttcgataaaaaagaaagatgctgaataagtttgtctatgaatatagaagccgggcgtgagtccggctttttttatgttcgtccatcttattcgtctgtcattttgacacacaaaaaaagcatgacctaattgaatagatcatgctcttatttctttttttacttaagtacgcaggatgagacttgaactcacacgccgtaaccggcactaccccctcaaagtagcgtgtctaccaattccaccacctgcgcattttaggaagggtgcccagaacaggactcgaacctgcacgatcgcaaaaccactcgcacctgaaacgtggggaaccattcaaacagatctatttccgcttaaggataagatagaacggttgctctgtaaataactcaatgtattgttttagaaaataaccctttattgggggggatatcaaataaatttagagaggtgggggatatttccgaggaggtggtatctttcgcctctctcatttttaatacgatcactatcaaccaagttaccaatctcgtacttttcggcaaactgctatacgatagtgtatcgttggcgtataaggcgtttttaagcccgttttaggctatataaccccgcccctatatttctcatgtgttttcttgaaatgttttgtgagtagctttaaataagattctctgcgattttctttgccctttggtttatatgtgatacatttgcgatgtattgaaaataacgtagaagcgttaagatattatcctatctctggaaactggacattttcatcacacgggataatagccaagatgctcctgcgcttatgttgttatatactaccctgtaaaggagaactatatacctcataaagcgtggggctattgtatattatcgtgtgatgggcagtccagagcctcagagataataatatcatagtccccacgcttcattttttagaaactaccgaacgaagggggcagtgagggtaattttatatattatgaaaaagacaatttttgtttttgtttttttatgcttctttatctttaattcttttgcgcagaatatgaagtttacgtatgagggtacaaggattgataatttcggtatgaaaagctatgatccagagcgtggttctatagaggttgatttttacagtaaaaacattaaaatctactggggaccatataaggtattgttcagtgccagtcctatttattttaagagtgtgcaccaaggaactacctttgacgaaaataaagcacttgtatttagtgaggctaaaacagtaaaagatgaaaactgtgccttctatatcaatttagatagaaaaagagcgacttttgaaagaatgggtaataatggaggtcttattatacatttcgaaggaattgttttcatcgaataagtgagtagtaagatttgcaaagacaataaatggagatatgaaaaacaaggttgtttataaaatatttacaataaggaatttgctgttagtgatttttttattgattatttcaatatcatatggtcaaactctatatctgtatggggggacaaatcatgatgtgtttttaggatgtataaactgtgatgattactcgtcaagttctatttggaatgaatatagcgaatatggatccaactattcatcaacgtctatttggaatgagtatagtgactatggtagtgagtatagtacatatagtccctggaatgaatatgctagttatcctcctgttatagttgattcaagaggtaatttctacggctatttaacgaccaatgagtatcatgcaaaaagagcaaggtctagtttagcattattattatgtaaatattacgatcttattagggaagatgtatctgtatggtataaaaagatttttgaatgatagctaagctaaagatatttcgtatagggctatatgtgttaaccttatgatctttactaaaggtgtattgtctttccgttatcgtttgttgattatagataaaaaacatgaaggataaaaatactaataaatgctttgatcgtgcttcttgtagctgggattgtaaacctcggattacgggtttaatacatgatccggttgaggaatctgaggcctatttatctatagagacggagttggaggaaaagctacgatcttacttctctgataaaaaaattgattctggtaactggtttcgtaccccggtctcatgtttcgagtattggcaagtgatgaaacgttttttatgggaggactatcgaatagagtggagatccccggttgaattgaatcctactatattcaaggatgatctttagggggtatttggggtacgaatggctttatatggcgtggatcggggcggcaccaaaggaggaggctgcgagcgggtgcggaaggcggcggcggggacaccagccccgttttctcttgtggtgcttggcgatgaggatatgaaacatgagcctattccttgcgaataaggggtgataactgataaaggggttatttatagatccgtcctatatcgtgtcttagagggcaaaagaaacggcctgaatgcaaataacactaattaaaagaaagcggtaaagttgtgaatatggtaaaaacgaggtttttgatcttctattcgatagtgtgtactatggtattaaataagttgttcctaatttgaggcgttatggtgtttttggtgttagcttgtataagtttgattatctttgaattatcggtttttataatccttgcatttaagacaaggccggtgcgatggacatttaagtctttttgtctttggttggtttctttggtctcgtggtgttgttttccaccattgtacgtatggattgagcggaagtggcggcaggctagtctaagaagggcgctatttgtgctgttatccccagtctcttttcttttcttggtggatgcctgtacgctcgatccgcatcgcttcatccataaccttgatagcctgataatagatctcaatgctattaatagagactggacagggattgatacgctgttatctctaatctctcttatttacttagtatatatctgttcattggtatgtaagtgcgtcaataagcctttctataaccgaagagatctttcaagcaaggtagggataggggcagcatacaagattgtaaattctcatggccgaaatggggatacggatgaggttgacattaggcttgattcgggtagtgaaacggagagttccaacaaaggatgaagacgaatcccccggctcattggagtatatcggaagatggtgatttcccattcgatgagaattagatgatggaatttacttctttatggatatagatcctagagagaataaggcatatatgtgatatggagggacttcgataattggagtcggaatgattttcgccatacaagatccttggtggtaggtcgaaaatgaaacaagttaccgatggtaaatcgaggttttttgcaatctttgtgttaaagaatttatgtatagagagaagttagccatgatgaaaaatacttacagaactatctatggagcgattgctggtgatattataggttcgatgtatgagtttcgttctgtcaagagcaaagacttcgagttatttccgtatggtgcctgttttacagacgatacggtgatgacattagctatcgcacgatggctaatggaggatgtcacccgctcagaatacacgcttgtagacactatgtgtgaatttggcaaccgttatccggctgttggctacggtggccttttctgcaattggttatgtaatgatccaaccccctataactcatgggggaatggttccgctatgcgtgttagtgcggtaggccttgttgctaagactttggatgaatgcttgcgcttagcgaaacaaacagccgcagtatcacacaatcatccggaagctataaagggagcgcaggctgtagctgcaagtatattcattgcgctacattggactggggaaatagacgaattaaaagtacacataagagattttgttaccaatcagttcgaatataacatgaaccgtacattgaatgagattcggccccgatatgaatttgatgtatcttgccaaggtagcgtgcctgaggctatcatcgcatttttagaagccgatagttatgaagatgcgataagaaatgccgtgtcactcggtggtgacgctgatacgcaaggtgctatagctggcgcaatagcggcttgtgtttatccaattcctgaatacattattaaagagtgccagaaacgtttatccgatgatctgttgaaggtcgtcatccgttttgaggattatcttgacaatgaatggcaaaataagattagtttgccctgttcgtgcttgcaacccaagcgtgaaacggttgagcctgagaaatatgtagatattatacgagacaatattgatttgatacacaaatcaattaaaatcgcagtggtgatggttgcatttatattggtcaaaatattatgggtttactggtcgtgtactgataatggtacatgggaggatgagaagggggaactcattcaacgtcgggatttcctgatcgatcgtgtagtaacttcaccacgtgcgttgttgtgtgaaatgccagaaggaattggaacgcaatttcaaggtgagtgggcgttgtattcttgttcaatgctggcggcagccttattcaatatgtcgaaactttatcccgaaacaaaaacagagaatctagagaacatagataatcttattgagatggtactttcctttgagttgagaaaatatgatgctgagcgttggggcgaggatcctctggaaacattggatggtgacaggagtcatatttcatatatcagtcatcttgcgtggatgataagcgagtataagatggccggaggaaatgataaatataataacttgtttgatgatctttgcggaactatgaatcgtcggcttcttcgaagtaaaagtctaaacttaccaacatatccaagcgaatgtatatatgtccctgatatgcttgttgcgattgtcgcactgaataattactcgaaattaaacaagggaaaatatatttctacggtacgtaaatgggtacgaaaggctaaatctgaatggcttgacaaagaaacaggcctacttgtctcatttttgagtgaggatggcataccgtttaaagccgccccggtgaaaggctcgtactccgcattaaactgtctatacctcacgcagatagattcagtatttgcaagagagcaatatcataggctcaaatcccattttttgcaatcaggtttattgtctggtatacgggaatatcatgattattcgtgttggttgggatttgacattgatgcaggcccggtactgttcaacctcagtccatccggaacagcattcgctgtgggggcagcaacatatttcaatgacgtgagagtacgtaataatttcttacgtacggcggaaattgcaggacatagtgtgatgtggaacaatactcgacattatttactagcggaaatagcacttgttggggaatgtatcatgttggcaatgcgaacaacaactccataggaaagaaatggaactttatatgaccatgtgatttaattataagggatagctgccctaaatagaaatgtaagtgttatagatctattttatacagaaccttcgagtgcaaaagaattggattggatacgagattatgataattataaagaaggagtatgaataaggtaaaatagtagttcttaatttgaggcgttatgatgttttttttattagttagtgtgatagtttggggtggtgggttactggctttcataatccttctattttgggcaaggccggagcgatggacatttaagtctttttgcctttggttggctacttgggtctcatggggatgttgtccgcctttgtacgtgtggattgagcggaaatggcggcgggcgagttggagaaggtgttcttatgcgctgttatcccctatctctcttattagcttaatatatgtttgctcgtttgtatcagatatcgtcaataagccgtatgggagccgtatggagatctcatacaaggtaggtgtaggattgccagcgtacgaggttatagatcgcacctatggaaaaaagtcgttcactttggactatattgatcggatagatattaagtttgaaccgggtcgtgaaacggagagattctattggtggatgaagacgaatcccccggctcattggagcatgtcggaggatggtagtttttactttaatgagatttcggaagatggaaccttcttcacaatgcgtatagatccccagaagggtacggcatgcatagaatatggagcgtggtagataactggggttcgattgttagggggaggccttgtacctgtggacggcagcagggggcttctatcattcctctgtttccctttggatgtttatgagttaaataaactacttgcgataccgctgtatggcagtgtaatttggatataaatattgatttcgcagtgcaaatgtgatgtttacagatacgattaaggagaggttttattaccgctattcttaccgcaggatctttgtcttaaattattaaattgatttataggtgtttatagtgattattggtattcccggcgagactacttttatttcctctcttttttatcaaacttggtcaaaacaagtaagttgatctccttattgttaaacgtttttttgtctcttgtataaagagagagtaaataaaataagcgttttcttactgcaggttgtttcttgtggtgagaatattgtttatatttgcgcaaggtaatcactaaaagatgaaacaacagataattaataagctaagaggctttttcagagcaaaggactgaaaatccttgtgtccccggttcgattcctggtggcaccacttttaaaagacttcaaatttggtaaatccctgaaaattaaacatttcagggattttctttttctcctaaaccgcatatttttggcaaaattacgcacttccgtagtgctaaatcgtggacaattttagtcttgaaaaaaatgtccacgaattgtaccgtaagtcgttgattgtcttatcgtttaactcttgctattctgcacgattcagtaactttaaacattaatttttagagtatgaaacgacagactttcaacgtactgttcttcatccgcaagacaagaacagtaaaatctggtgagacaccaatcatgttgcggataacaattcaagggcaattagctgaaatgcagctaaaacgaaccgttaagcctgaactttggtcgcaagctaaggaacggtgtacaggcaaagacgctaaatcagtagaggtaaaccgttatattgaatcggttaaactacgcctgtacgatattcatcgaactttggaagatgaaaataaacttatcaatccgatggaagtaaaacgtagatttctcgggttggatgaaaagcatctaatgttctttgaagtttttcaggaacataacgataaatgccgtgagttgattggcaaggattatgctaaagtaactatctcccgctttgatacttgtttacagtatttcaaagagatggctttgaaaaagtaccatctaaaggatattcccatgaaagaaataagccatgccatcattcaggactatattcatttcctgaaagctcaaaaggacttgcaagaaaatacggtaatccgttatatgaaagtagttaagaaaatcaccaatatggcattggctaatgattggatggagaaagacccgtttatcaatatccgtttccacgagcaggaagtacacaaagagtttctaaccaaagaagaattagaaactatgcaaaacaaagtttttgatgttcctcggctggatttagtgcgtgatatttttctattccaatgcttcacgggattagctttcatagatgtatctgaattaaaagcagaacatcttgtatctgataatcaggggaatttatggattaggaaagcaagacagaaaactaaagtcatgtgcaacattcctcttttggatatacctttagccatattggagaaatacaaagggcatccactggcgaaaaagaaaggaacattattacccgttccatgtaaccaaaagctaaacagttatttgaaagaaattgctgatttatgcggtattaaaaagaatctaaccacgcataccggacggcatacattttcgactgttgttgctttagctaacaatgtatcattggaaaatgtagccaaaatgctcggtcataccaatacaaaaatgacgcagcgatacgcaaaagtattagatcagagtattctccgagatatgcagaatgtacgagagaacttctctactaaaaccacctaaagataaaaacggctaccgtcctaatggattgggtagccgtttctctatattcatcctattaaaactaaagagaataatcttctatattataggcagaacgaaatctatcttccaatactttcctaatatccgattcacgaaacagcactttgcccggaagttgaataaaagggaaaatgccatcaccccgataatactgcaaagtcctacggctgattttgagaatagaacaaagttcttcgcttgtcagataccgttcaccctcaaacatgggcttattattcttcaatgcatattctatataaggtaaagccctatctaacgattgcaataattcttggctatcctcatgcgtgtataaatccataagcaattattctttggtggttacttttattctacctgaatccaatagtttttgtacttcggcaaccttataatatactttcttgccaacggtcgaaaaagaaagtttgccgttctcacgcaaagactgtaatgttcgcaaaggaatatttaaggaagctgccaatgtcttgccctctatccattctttctcaatacatatatctgaggaagacaaagaaatattgtctgccaatgatacaatctgttccagcttctttcttagagcatcgaaggaaactctttctattgctactatatccatatataaattacttttcaaaattcattatctcaatccttttttaagtaagttttccagaacttaagatgaagcattgacaaaggtaagttccgtatttagcctattcaagtccaagccttcagtttagaaaaaaatcttcctctcattaacattcgagcgtatttttatccaaagacttgcacagactaaatacttcactggaaaagtcaatgattcaaattaaattccgaaaaacaatgtttttgagaacggcagattattccttccagctttcaaagtagtgcttttgcagtagtttatcaatatcactttgtcgatagatgatttttccttttatttggataaatagtattaatcctgtatctcgccattcttgcagagttcgcaaactgacattgagctttttagaagcctcatgattggaaagaaatcgttctccgttcagatggggcttatagtgctttacaatcgattcaataccattcagtattgaattaagcgaagaaataaattctttaacttgtggtgtatctttatttattaattccatgattgaaagattgttttattgaaatattgatttcaagattgctagatagctaatcagttgaatgattaactgattgattagtttcgcagatagtcacccagtgatgaaaggctaagcacgtcttttgctggatcataatctatgtaaatccgtttaggagcaggagctataaaatacaggctgtcttctttctgtatttcataagtagcgggtgaagcctgtttggtggtttccgatacatatataatagagagaagataatcgttgtcattccggtagatgattaccgtaggattcagattaatgctttcccatgtgccaacaatggagaacaggttgaaagatggataatcttctttagttcttttcataaggcgtgatttgtttgggtgattgattttgtgtttcactatccgcaataattctttcaacatcagaagacttataataaattttgctccctatttgagaataagccagtcgcccactacttcggtaatattgcagcgttcgcttactaaagcctaacaacaggtatacttcctgactatccagccagttttctactttctgagtatgagtgctgcacaaactctctatccgtttggcaaactccgtgaacctctcacagacatacgaaatggttttcttttcaatggttactacttccattctttcaatttttaatggtttataaaacgtgtgattctattttcatcggcaaataaaggaagaattaagagccgttttcaaaactgtctaaggatggcatagtaagttcagcattggcttgatggcaaaaaactttctgccatcgcaatttagcaagcagattatttgcatgtttccgataagtaacatatatttgttcccaaatagtaacaatgcgtaaaatgaaaggaaaaagcataacaggagaaagagatcgggaagctaccgaaaagcggttgctagatactattggtaaaatgattgccgaagatggcttcgagaaaatcggcattaacgctatagctacccaatcaggtgtttcaaagatattgatataccgctatttcggttcggtagagggacttatggctgcttacatacggcaacatgatttctggctcaatttcccacttgaatatcccagccgtgaaaaactacctgcattcgtgaaaagtatgtttcaagaacagattgagcaattaaggaataatcctactttgaaaaggctttatcgctgggaattatcttgcaataatgatatgattgtaaagctaagagagcaacgggaaaaagtgggaatagaccttgtaaagaaagtaagcgaactaacaggacatccccaaaaggaaattgcagcaatagcctctatgctgacagcatcaattacttatctggtgatgctggaagatttttgtccggtttataatggcattcctctgaatgaggattcaggatgggaacagataaacgaaggaattgaaattctaataaataaggtatttgaagatgaaaactgatttcatacaaatagccagttatgcttctaaagctccttcgggacataacacacagccttggaagtttcacattacggacggtactattacagttctccccaacttagaggtagcgttgcctatcgttgatagaaacaatcgtgagttatttattagcttaggctgtgctgttgaaaacttatgcatcgctgccagctattttggttacactacccatataatagaatgtagcatagaagcgattattcttgaattaacgaaaaatgatctcacaattgaagattccctattccatcaaattgagaaacgacagacaaaccgcaatatctataatggcaataaaatatcagatggaattctacaacaacttcaatccattccaaaagaaaatggtattcaattctactttactgaaataaatacgccatttgcaaatacaataacccaatacataatgaaagggaatgaaattcaaatagctgatattgctttcaagaatgaattgctttcgtggatgaggtttaataaaaaacaagttgaggctacacataacgggctaagttatttggttttcgggaatccaccacttcctagaatattagcacgtcccatagttagcttattcttaaaacctaatgcgcaaaacaaatcggatagaaagaaaatagattcttcctcgcattttgttgtatgcaccacacaacaagatacaatcgaagagtggattaacttggggcgaacactccaacgctttctgttaaaagtaactgagatcgggatttcttatgcttttttgaatcagccgtgcgaagttgcggcattagcttttgacttacgagagaaattacctgttaataaggaacacccaacattaataatgagaattggttatgcaaagcaaatcccttattctccccgtaaaaagattgaaacattactagtctaatatttttttgattaccatgttcccgattagtaacaataataaaataacaatttaataaaactaatatgaataaaatgggattgacattgatttatttatggcttgtcagcctttgttcctgccaacaggaattgattgagtatgagaaaggagacgtgaaagtatgcattgaacagggtgaacaatggctgcatgactttcctttgttcttaggtatcaacaaaaagaacccacctcaaattgctgtctggttggaagatacacaagggaattatctttcaacggtctatgtaactcataagatcgccactcaatcttggcaagcatcgggaggaaaccgacgaaaagaagctctacctcattggtgctattcacgtggagttaaatacgatgatggactttatttgcctacaaagaaagagccattaacagatggtatatcaggagcaaccccacatggaagttttgatatcaaattaagtccggcaatagcattaaagacattcgtagtaaaaatagaaataaatcattccactgatttcaatgaagccttccctaaatcagccaaagaaggagaagccaactattctggaggtaaagaaggaagcggacaaccagcaatcgtatacgctgccaatgtagatttatcggcaggcaaaaaatcatttgaagcaaatctggtggggcatagtagccctaatggtagttccggaaaagtcagtaaagatacatcagggctgacaactgctttacatatcgtaaaacgtataactgtaattatccaatgaaaaagattattctgcttattatagtaagttgcactgttgtaatggcaacagcacaacagacagaacgcttcacttttgccacaagtgtagggacaggaattgacatgaacgagccgtcagccactccgtttacatggcaagctctaggctattatgcaatcaataaacggttctcggtcggcattggtacaggattatcaatttatgaaaaagctctgattccgctatttgctgatgcaaaatttttaatcataaagcctagaaaattcactccctatataaaatgtggtgttggatatagttttgcaccggataaaaatgctaatggaggtttttatctgaatccgtctgctggggtagaatattctatttataaaagtaagaagttattcttggctttaggatatgaatcccagaaacttgaacagctaaaaacgcaaaagcaatcattgtttacagccgagtttgcagagaagctaatccataatgctatttcaataaagattggattcatcttttaaagacatacagaaatcattcagcaacatgtaacagactttagtctgattattaatacacattaattattaaacacttcatgcctatgaatgatttatcaaaaacgaggattatcatcttattaactgattcctcacaaaaagtaactgacacagaaatgcaagacgcttatgacgaatttatcaggaacatagctacaattggtagttcaaaagataactccaatatctttcggatgctgaatctcactcgtattgagatagcacccttaaaagagctatatcagtgcgagcagggaaaaaaatgcgcttaaaaattattatttgcataaagtgctagctattatcaatgtagaattggaactattaagtctaaaaattaagcatcctgaatcatttgattcacctatctcaccaacattcgtatcagatctatatgtaatccctaagtcaaaggacttggggattattggtattgctgaaatagtaatagggttatcttttttaggcgaagtagtcggaaaagacggaaagcccgtcccattagttcgtttagctcacggttttgaaatccttttcaatttaaaatttggaagtatatacgataaactggatgctatctttatgcgtaaaccattcaatctgaccaaaacattagatgctttaaagaatgcaattaacaaagaagcccgtaaacgagctaataaacattagacaaaataattttataatcctcttatttacaagtatttgaatttcattttaaagggagtaggtaactactcctctttttctgattctccattctgccgatttttgcatcatcaatcgattgacattcatgatgtatcactaaaaaatgaagcaaaatgtatatagacaacgaaaacttcgagaaatggatgaagaagctatccaagaaactcactgaaatagggaaagatttaaaatccctaatcaataccgataaagtattagatgataatgaaaagatactcgataatcaggatttagcctttcttctgaaagtatctttccgaactcttcaacgttatagggtaagcggagtactacctttctttaccatcggaaagaaaacttattatcgtgctggtgatatccggtctttcattcgtgaacgtgccgatttccaaacctacaaacagtttgaagaagccaatcaattaaagaatcagccttgaaagcaaaaggtagcaaatttaggaatgaagcattgctgctccttccttgtgctaccatcctaatttagcagaaacagctacgtcttccggcttcgctcatttcgctaaattgagcaagagggaactggacaagtcctgttcttccctcttgctctgcgaggcaaagccttcggctttagcgtgttacaagaacacgctgtaatgacacctgtaataagcattttccattcaaggtttattatcaggcatttatctatccatatttctataaaaaagtaattaccatgccaaacagcagtcgaaaaacgatattcaccaccatttccatagacaaggaaacggcagctttagtagaaaagatatgcaaacgctattcattgaaaaagagtgaagttgtaaagttggcgtttgggtatattgataaggcacatatcaacccatccgaagcacctgaatccgtaaaatcggaactggcgaaaataaataagaggcaagatgatattatccgcttcattcgtcactatgaggaagaacagctaaatcctatgatacgagcaacaaattctatcgctttacgtttcgatactaccagtaaaactttagaagctcttattctctcgcaactggaaactagtcaagagaaacaaacagccgtacttaaaaagataagtgaacaattcggcaaacatgccgatgtaataaacaaccactcccaacagattaatgcactttaccagatacatcaacgagattataaaaagctgtttcacctaatacaactttattcggaactatctgcttgcggtgtgatggatagtaaaaggaaagagaatctgaaaaccgaaatcagtaatctgataaacccatagagctatgcacatagactttgctccaccatcaaacggaacatataataatgctggaagttgccgacagctagcaaattacatggaacacgaaaatttagaacgcatggaaaagggtatctataccgaagactttttcaatctgacagatgataacatctacaaatcaaaagtgataaaggatatagatagcaatatcgggcagctcctaaaaacagatgctaagttttatgctattcatgtgagcccatcggaaaaggaactccgagtaatgggtaatacagaacaagaacaagccgaagcgatgaaacgatacatacgggaagtattcattcccgaatatgccaacaacttcaacaaagaactatctgcttcgaatataaagttctatggtaagattcattttgaccgcaatcgttccgacaatgaactgaatatgcactgtcatttaatagtgagccggaaagaccaagccaataaaaagaaactttcaccacttaccaatcacaaaaacacgaagaacggagtaatcaaaggtggctttaaccgtgtaaatctgttccaacaagcagaacaaggttttgataaactgttcaattacaatcgccctcaaacagaatcatttaattactacaacacaatgaaaaatggctctatatctgaccgatttaatatagataaacaatctcttatttccagtgaaagaaaaatagaatccaattccaattatctacaagaaaacttgttttttcccaatcatgaaagcaagcatacaaacaacataattttcaacacacacgataatgctactgtaaagcaaaataggcatatttctatcaattcatctagcaatcaggaaagcaatcaaagatccaacttgctaatctcctttatttcatctggaacagtctttttaccgattccaaccgattccaaagaaaaaataactaaactccagaagaaaagaaagaaaaaacgcaaattataatttgctactgttgaatgctttgatcaagctccaaaatattttttgacaaaacggagaatgcatgaataattttagttctatatgtgtattttgtaaatttagcaccattaaaatttgctaatacctctatcgcccaatatgaaaaatcactattatccacaatgaataaaacttcatgagctaacctattccttagggtatttatttgtgttaatgcaacaacaaccttttctaatttatttctatctgttacatttaacttgtcaagtaatccgattttccgataaaatgaaaatgctctacagtcatttacaccatttcttaaaagaatcatatctaatatcatttcaagtaataaatgacctttcaacaagattgtttcaagatctcgcttcttctcaagactgccccaaacaacccattctgctaatatatctaattctttgctcataaacacaacgatgtaaagtaaatctgtccttattttctgaaatacaaagatatagtcaatttagatagtctactagtcatttccgctcaatttcagatattaacttcgaaaaccttatttctctatttttcagtgctttaatttcacattgccatataactacaacattccaccctaatttttctaattcatttattttcctattatcacgttctatattcttctctatttttgttacccaataatccaaattactactaggcaaatgccctgcacgacatgtatgtccatgccaaaagcacccatgaacaaatattacagttttatatttggataaaacaatatctggtgttcccgacaaagatttcacattaatacgatatcgaaaacccttagaaaacaagaatttcctaacaatgatttcaggcgcagtattcttttgctttacttttgccatgagttgagaacgtttactcttatcaaaaatatccataaacaaaaaaactaaatatttgacgaagttaaaaagattttcgtcaaaaacacatcatttcaagatattatatgtaaattcgcataatatatatgttacagtaaaggaaggatttattatatgtcaaacaatgatacaataggaataattgatctattctgtggaattggaggcttgactcatgggctaaagaaggctgggcttgatgtaaaagccgggattgactttgataaaagctgtaaatatgcttacgaagcgaataatgacgcaatttttatcggagaagatatatctaaaattaaaggcaaagatataaaaaaaatatggaaagggaaaaaagtaaaaatccttgtcggatgcgctccttgccagccattttcaacacatgccaataaagttaaaaataaagagaatggggacaaatggaaccttttaaatgaatatcttcgattagtagaagaaacaaagccaaatatcttgtcaatggaaaacgttacaaatttggctaataaagaaattttcttcaaattcataaacagacttaaggaattgaaatatcatgtattctataaaaacgtgtattgtcctgattatggaattcctcaaaaacgaagaaggttagttcttcttgcttccctatacggtgaaatatccttgctaccagctacacacaataaagaaacatacaaaacagtaaaagaagctattggagacttacctgctattgctgatggagaaaaagacgagaaagattatttgcattttacttcgaaactatcagctattaatcttaagcgaataaaatcatctgttccaaatggaaattgggaagattggagtgaggatttaaaattagaatgtcataaaaagaacacaggaaaaacctataaatctgtctatggtagaatgtcttgggatgaaccttctccaacaattacaacacaattttataattatggaacaggaagattcggacatccagaacaaaatagggcacttacagtaagagaagcgtccattttacaaacatttcctattgattataaatttatcgagaatgagaatgaaatatatatgacaaagttaggtacgcatattgggaatgcagttcctgtacagcttggttacattattggtgagagtataaaaaaacatcttaaagaataccgcttatgaattcatctttcacattcaacatttcactaagtgttttaaatcatttaggacgtaacttatatcgaaattttataactgtacttggagaagctatctcaaacgcatgggatgcagatgctcctaatgtgtggatatatgtaaacagagaagctaactctctgacaattaaagacgatggtcatggtatgactgaggatgattttcaaaataaatttttgaaaattggatattcaaaacggaaagacggtgaaacaaaaactaattcaggaagaccatatataggacgcaaaggaattgggaaattggcattgctttcttgcgcaaaacgaattcatataataacaaaaacagccagtaccgattttgttggaggcataatagataatagtggtcttgacaaagccatagttgatgatttaactccacaacaatatcaattagaaaacattgatacaaaattctttgatggtcttaagaatgatttagaaagcggaaccattatatattttgaagacataaatgatggaattaaaaatagaattgaatatattagaaaactaatagcactatttttcagattctccttattcgacaattcatttaagataattttaaacaacgatcctatcacattgaatgaattaaatgatttatctcaaagtactcaatttgtctggcaagttaactcattagaagatccttatttgaaagataagatatcagcaacaagagaacatataaagcaatataaaaaattatcatcaaaattatcaataaatggatttatcgcatctgttgacaagccgtcaaatcttaagataagaggcactaacgaaaaaatatctgtagatttattcgtaaacggtcgattaagagaaaaagatctacttaaacatatcccttctacacgaattgtagaaaactatctttatggacaaatacactttaatgaattggatgataatattgatcggtttactagtagtcgagaaggagtgatatcagatgatcctacattccaaaaactattaaatgagttaaaagatgatatactcaaaacaataatcgaagattgggatatttggagagttgaagaaggcagagagggagattcagacaatactcgaatgacaaagagagagcgaaagtcaaaagaattatatgatacagtagttgatgaatatgtaccgcctaaaagttctgcacaaagaaatattgttgatgaatgggttaaatcgctaagagatgatgctcaattcaatttgtcaacatatgcagaatgctttgtatcggaaaacttattaagaaaatatattaaacacaagagtatgcccctttctacagaagcgcaagcaaaccttgtgaaatataagcaaagagagtcggaagcgaaaaataaagcaaatatcagttttgaaatcaggcaaaacgcagacgatttactatatttcgacatggatgacttggcaaattttgtagacaaaccagctgatcctaataaacaagcaggaatcgcaagagatgcaaaggtttacaaacctgttagagatgcgatggcacatacttcaattcttacacctgttgcaaaaaatagtttaaatacaacttatgaaaatatcaaggcgagaataaaaagactattagaatgagtatttataacaaatgcgtaacattttattttatgtggatataaaatctatatttatcaagggaaaatcgggaaatagttacattttactaaatttttaatattttgctaggtttgcaacctattattattttaatcagaataagacaataactaaattattttccctatttttgtgtacgtaatcgttcttatagcgagcaaaacgataaaacataatcgtgtgctaatcatgtggatttccaaatggaagaaactataaaacggtgataatcaacatagagaagacaatagttctcttgctggtggcaccactttttaagaaggcaaaacgatgtaaatccctaactttcaaagaagtttagggatttttcattttcaagaataggtaaaataagtgggactaaagtaaactatacatccttattcgggggatagttttagaaagcctaaaatgttacacagcacaagtgctacttcgtttttttacagcacattgatctattttacataaccgggttctcggttcgatttcctaactttgtatcattaaaaattgagctgtatggaaagagaaatattcagcgtgttgttcttcattaagcgtagtaaaacgttaaaaacgggaaagtacctctgcgtgtgaaattctatcagatttaccaagacttggaattggaggaaaagattgtctccgcacgtgccatagtaaatcgctatcagggaaaggacgaaactttcaaaacattatataatgtgttcaaggagtataacgacaacttggaaactcgaatgaaacagatccccaatatccaacttaaattgacccccgatttatttttcctaaaatacaaaaaaaacatcatataatcagttcattagctttcgatttgtgctgggtttgtaatttttatttactgccaatatagtcattcatttcttcccgcaaattttgcgtaaggactctccgtgcagctcaattcttgcggcttggtgagttattctgtacatgactgcgccggctattgtctccttgccgatgacatcatacttgtctttgaccggcaattgtgatgcaatcagtgttgatttcttaccatatcggtcttcgatgatgtccatcagatgcattctgcttccgttgtccaacggttgcaagccgaaatcatcctgtataagcatatccgtcctttctatctttttcagctcctacaggatgctaccttttaccttggtggccttcaactgccctaaaagtctggaagtattggcatacagcactttcaatcctttttggcagactctgtatcccaaggctgtggcaatgtagctctttcctgtaccggagcttcccatgacaaacaagtcgcacacctccttgacaaatcttgttcatgctgattgatttattgggaatactatctgttttgtctatttaatagattaatgtagaattatgaactgattctgtaactcttttaatgttttttgggtggggcaatttaaattggattttggggaactctttagataggacaatggggggacagtttataccaaattttccacctgtcaatacacagaagaattttcattgtttattaccgaaaaatagaagcagtctctacaaaaaaagactgcttctgcttcatttctagaacaaatcaaaaaacaaatatgctcaactattaatcttaattttcttttaagaaacggatgataacacaggtttgtctgatacggaaaacaagtgttcactaagcgccttcaaagcatgcactttatcttccgctttcatcaccaacgatacattactactacttccgccgtatgaaatcatccgtacgggaatatctttcaatgcattgatgatgcgtgcctcaaaaccgacattttgccattccaggtcaccaacaacacaaacaatcaccatattcttttcgactgtaatcgttgcgtatttccgtaatacacccacaatctcgtctatatgcttgtcatcatcaatcgttacggaaaccccgatatcggaagtggtcaccatgtccaccggcgtattgtaattatagaacgtatcaaacacgatgctcagaaaatgaggtgtcggtatcgtatggagcgacttgatcttgacatacgtgatgttgtctttggcggcaacagctttgatcgcacccttttccgccgtgttcgagatcaatgtacccgacgcacttggctgcaatgcgttcaagagacgtaccggtatgttcttttccttggcaggcaggatgcaagtcggatgtagtatcttggcaccgaaatgtgccaacttagcggcttcgtcgaagttcaactgcctaacaggagcggtgtcattgacaaaccgtggatcgttgttgtgcatcccgtcaatatccgtccatatctgtatctcttctgcttggatagccgccccaattagagaggcggtgtaatcgcttcctcctctttccaagttgtcaatgctgccgtaagcattccggcagatgaaaccttgcgtaatatatatttctgcctctttgttttgctccaaaagtgtatttaggtgtttagcgatatattccatgtccggttcattgtccattgtaatccgcatgaagtttaacgcaggcaataaaactaccttcactccttgttcttccagatagcaggtcatcagaaaggttgatattagctcaccctgtaccaagatttccttttcatcgaacatgctgaaaggcatattagagaaagaccagacatgttgagaccgttcaagcatgtattgcatggccctttctttgtaggtatcgctttggtataattcttctatatgattgacataagcttgttccaaagcagaaaggatcgcattggcttttcccggatctttcttatggaaacactcagatatctccactaaagagtttgttgtccctgccatggcagagagtactactattttctgttcctgatcgcaaatgattgatgcgacattcttgatccgctgggcagaaccgactgaagtaccaccaaattttaatactttcattagactatctgatttttgattttactttttatacattgaatctgatcacgaacgtgctacctttaccgacttcgctttcgatacggatcgtaccaccatgagcttccacaaagtccttgctgatggcaagtcccaaaccgctaccttgtacttttgttcccggcacacggaaatagtggtcgaaaatactttcgtggtaacgcaagtcaatgccctttccgaagtccttgacatagatctcgacggctttgtcgatctgtcgtgcaccgatgataatccgtccgttctccgacgaataacggatggcattcgataacaggttggtcacaacccaagcaattttctcgctgtcgacaaacaatttggtgatcttttcaggatactccacttcgatctgacagttaaaacgctcggcctgtacccggttcgccttgatggcatagtcgatcagttcgatcggtttggtaatcttcggattcaggtagagcttaccgctttctacctgtgacatcttcaacaattcgccagtgatctccaacaaacggtcgctattttcctttatgttcttggaaaggctctcctgttctgtattcagttttccgaaccgattgtcttccagcagttccaagctcatcatgatagccgatatcggtgtcttcagttcatgagagatcgttgaaataaaggttgtctttgcaatatctttttctttaaattcggtcacgttcttcaacaggatcacatccccgacatacttactctccagtccagtctgcctgttaacgttgatcgggatgtattttacttgaaaatagctttccttgttgtccgcatagattttcaacggatccttattgtcatcgggatgtaccaactggcggatcaaacggcgcagcagatcattttttaacgccacttcgggagccggtttgtcgataatgttttcccgtgtcaaattcaaaacagtcaaagcctcgtcattgacaaacaaaatcttccgttccttactcaagcctatgataggttctgcaatgctgttgataattgtttctatatattttttcccttgcaggatatcttccagcgaactgttcctgtattcggccaagcgctcggccatctcgttgaacaacgtggctatttccttaaactccggttcattgcccaaattaagccgtttgctgtaattggcattggtgatttccttgatgccatccgtcaatttccggatctgtacgctgaccgagcgtggcaggcgagccagaaagaggaaggcgatcacgatacaagcgatccctaccgtccagatccaaaagagagacctttccgccgtatggacagccacttcattcttttcataaatggcagacatattgactgccataatggtataaatcgtctggcgtatctgccgaatcgattcatcatccatgtcatccaacgccttttcacagttcgaacttaatcggttagtcagtatgtcttcatccttctctgtcagattttttttctgagcttccaacccggcctcaaactcttttcgggcattcggattttcccgaatggcatccagtgactcgagcatctgacgggaataaaggagtgaattgtaattatccgctaggatattctgcgtgtcatccgatacattatgaatgttttttatagccaatccacctaataaagtgatcaggacaaataaaagtcctatcccataagtcaactttgtttttatattcatattcatggaaggatttttatgctaatattattaaatcaatgcctaattgagccaactcttctaacatgttccgatagtgaaccatcgcaaggatagcggaaggatattttaaagctggtcgtccgatacatagcgtactgatttgcttttctttacaaacctgtacgatcgcatccgttatatgtggggattgcacttgaatgatttctcctccaagttccgttgccaacttgaaatggttaagcaaatgcctttgacttgccaacggaatcctgtcggaactttctcttggggtttgtacatacagtacaaaaaacttggaattatatcgggttgccaaccgtgcgactttccgtatgatcttacggggagttttctcattactgctgatgcaggccataaacctttcgtggcgtacgccgagattctctggaatggtattctccacttttttttctacccgcaaagctacctctttcaatgccaactccctaagctgaagaatatgttcagccttaaagaaattatttaatgctgtttgtatcttatcgggtttgtatatttttccggcttttaaccgagccagcaattcgtcagcggtaaggtctatgttgaccacttcatcagcctgctccagtacgatatcaggaatacgttccttgacctcaatgccaaccacgtcctgcaccatctcgttaagtccttctatatgctgaatattgaccgccgtgatcacactgataccggcatccagtatatccatgacatcctgccaacgcttttcgttcttactgccttcgacattggtatgagccaattcgtcaacgatgacaacttcaggatggatactgagaatcgactgcaagtccatctcttcgatctcttttcctttataaaatatcttgcggcgggggatgataggcaatccttccaccaaagcctccgtctcgactctcccatgtgtttctatataaccgatcttgacatcgataccgctttccagtaattggtgggcatcagatagcatccgatacgatttacctacaccggcaatcatgccgatgtagattttaaaattgccacgacgagactttttcaacaaatctaaaaaatgttgtacactttgttctcggtccatgcgtattattatatcaaggtcttaaagaaattcccaagacaagatgggcatcctccatacgagggttccaaattgcctgtgtaaaaataggtaatgagaaagaatccgtgattttgatatctttcgttgctttcaatgcaacattcgttactgcaaatccactatttacatcacctccatacgtagttattcccgcatcatacggaagaacaccacaagttgcattcagatcgacgcccttcactgtgaatggaaaattcaactccacataagaagaatagttttggtttccattttcatctttgtcttgaccggcaaacatgaaattccaagtgatagacaaaggtaacttctcaataggtaaagtgtaagccaaacctgcttcaaaatggtgatctgtttcatggcttttgaagttaaaataacggcaagagccttgccctgcccaccataagctagcgacagataatgtaggaccagctgatccgaatgtatacgctgccgttaaatctatctctttagccgcaggcatagatgtagagtttgctccctgaaaatcggtagatccccaggctgtcaaagagaaattacctacccccagtgatagtgtcggctggaagctagcaccagcttggtagaaaccacgccaaatataggaacttaccaaatctccctgtacagaaaaacttactttaccatcctcttcctgtgcattagccaacgtagaagatgccattgagaatacaactgccaaggctgctactttttttacgaatgatttcataacctaaatctaattgacttattaaaaatttgttatttgttatttgatgcttgatcaagcgcaacatttaatttcaatacatttactttctccgttccgaacatacccaataacggtttctcaacatgagaattgacgatacccattaccttttcttccgaccatccacgagcgtccgctacacgtttggcctgtgcataagcggctttcggtgagatatggggatccaaaccggaactgctggccgtgatgatttcagccggaactttttcacgggttaggtaaggatgatgaaccaagaatgtatcaatacgttcttccaacaaagctaaatgttcttcattggaaggtcccttgttactacctgccgaactggatgcatcgtaaccgtcaccggcatgggaaggacgtccccagaaataaatatcttgcgtgaaattctgaccaatattggcggcccccactacttttccattcaatgtaaccagttcggcattacccttattcggtcctgccacttgggcaaacaaccacaaaacgaaaatgtagaaaacactgaagaacaaacaaaatgcaattgtcagtcttaatgatttaaaaagatttgatatcataatgaattattgttttattttcttaaccttcctcctatcttcatacagagggaggaaggtttttaatattgattttacttttacatgaataaacttacaatcatatctatcaacttgataccaatgaacggggcaattacaccgcccaaaccgtagatcagcaagttgcgacgaagcaatgcggaagcaccgatcggtttataagccacaccacgtaatgccagagggatcagaatcgggatgatgatcgcattaaagatgatcgcacttaggatcgctgattccggactgtgcaggtgcatgatgttcatcggggccaatgccgggatcgtaaccatgaacagagctggtacgatagcgaaatacttggccacgtcgttagcgatactgaaagtagtcagcgtaccgcgagtcatcagcaactgtttaccgatttcgacaatctcgatcagtttcgttgggtcgttgtccaaatcaaccatattaccagcttccttggcagcctgcgtaccactgttcattgcgacaccaacgtttgcctgagccaaggccggggcatcgttcgtaccgtcccccatcatggcgaccagcttaccgttttcctgttccttacggatatagttcatcttgtcttccggtttggcttcggcgatataatcgtctacaccggctttttcagcgatatattttgcggtcaacgggttatcaccggttaccattaccgtcttcacacccatcttacgcaaacgttcaaaacgttcttggatacccggtttgatgatatcctgtaactcaatcacaccaatgatgaaatcatcctgtgaaacaaccagcggagtaccgccgttactcgtgatcttctgaaccaaatcggccacctctttcggatatttgttgccggcagcctcactcatcttacgaatagcatcaaaagctcctttacggatgcgagtaccgtttgctaaatccactcctgaacatttagtttctgccgtaaacttgatcatctttgatccggatgtattcagatcatgtacacgtacacctttttcacgtcccaattccacgattgacttaccttcgggtgtatcgtctgaaagagaggacagtagacaagcttgtacaaaagagtgttcgtcaatgccggataccggatagaactgggttgctttacggttaccgatcgtgatcgtaccggtcttgtcgagcagcaaagtatcaatgtcaccggctgtttcaaccgccttaccggatttggtgatcacattagcagacaacgcacgatccataccggcaataccgatggcagataacaaaccaccgatcgtagtcgggatcaaacaaacgaacaaagagataaaggctgcgatcgtaatcgtcgtgttggaataatcagcaaacggtttcaaggtaccgcaaacaacaacgaataccaatgtaaaacctgccagcaagattgtcaaggcgatttcgttcggagttttctggcgagaagcgccttccaccaaggcgatcatcttatccaagaaactttcacccggttcggtcgtcactttcaccttgatctggtcggacaatactttcgtaccgcctgttacagaactcttatctccacccgcttcacggatcaccggagcagattcacctgtgatggcgctttcatcgatagaagccagaccttcgataatttcaccatcggaaggaatcgtgtcgccggcttcacaaataaagatgtcgcctttcttcaactgagaagaactgaccgtttcgatcttgttaccgacacacaatttggcaggagtttcttcccgggtcttacgcaaactgtcggcctgagccttgcctcgtgcctctgcaatcgcctctgcgaagttggcgaaaagcaacgtggcgaacaatacaataaacactaagatattgtaaccgaaagatccttgcgttgtatcaccggtggcagcagcccaaatcgtaacaaacaacatgacgaacgtcaccacctccacgataaacatgatcgggttacggaacatcatccgcggattcaacttaacgaatgattgcttcaaactttctataacgagctcctttggaaataaagaagcagttttgttatttctcatcttcttaatctgtcaattagtaaatactaaaatattcggcgatcgggcctaatgtttgtgccgggaagaatgacaaggcagcaacgatgacgattacgcagaatgtcatcacaccgaatgtaaccgtatcagtctttaatgtacccgcactttccggagtgtacttcttgtttgccaaaagacctgcaatagctacctgtccgacaattggcaaataacgtgaaatgatcagtgccaaaccgcaagtgtagttccagaaataggtattgtcgcctaatccttcaaaaccggaaccgttgttagcagaagaagaagtatattcatataacatttcactgaaaccatggaaaccggggttgttcaaccagccaccctcgctctctacgaattcaggggcatatacccatacgtaggaagagatagccgtaaagatcaaaatcacgaacgggtgagccaacgaaacgatcgtcgcaatcttcatttctcgggcttctacctttttacctaagaattccggcgtacgtccgaccatcaaaccgctgatgaatacggctataatcaagaatgcatagtagttcatgaaacctacgccgacaccaccaaaccatgtattgatctgcatgttcaacatctccaccataccggaaagaggcattgtgctgtcgtgcataccgttaacggaaccattagaggtgacggtcgtagtcacagaccacaaagcggttgcgcccggacccagacgggtttccttaccttccatagcaccgcaagactggtcaatacccatctcgtcgattttcgggttacctgccatctcatagtgaacgttacagaatacccccaaaagataagcaaacagcattacaccatagatcacataacctaactttttacgtttcagataaaatcccaaagcaaataccaatgccatcggaatgatcagaatagaccagcattctacaatattggtcaggtaagtcgggttttccaatgggtgagaagagtttactccgaagtaaccaccaccattcgtacctaactgtttaatcggaacgattgcagctgtagggccttgtgaaacagtttgttctgctccttccaatgtcgggattgtcattttggagtcgaagcccatcggcataccttgtatgatcaggatgaaacccacgatcagagacatcgggaaaaggatacgtgtacagctgatcactaaatagtgccagaagttgccgattgttttagttgttttggtagccatcgatttcataattccagccatagcagccatacctgttgcagcagtgatgaactggaacaacatgatgacgaacaactgtgtaaaataagtcaaaccgctttctccgctatagtgctgcaagttacagttaaccatgaaactaatacacgtgttgaacgccaaatctggactttgtccgctgttcccatcaggattcaaaggaagatatccttgcgataccaacaggatcataccccagaagaaccaaaatacgtttataataagcagagatttcaagaatgccttccaatccatctcttcattggggttgatacccgccagtttgtaaataaatctttcaattggagccatgaaacgcatgcagtcgtttccatccttatacaccttggcgatatgctttcccagcgggtaactgataaccagcagcagcaatatctgcaatgctacacctaaaatttctgtattcatcttttcacttaaaaaaataattaccattaaaacttttcgggcttaattaggacatacatcaaatacccgaagatcaataagcaaagtataaacagtgctaaaaacataatttaattctcctttcttacattaaattttctcaaaccagtccacacacttgaagaaaaaccaatagcatactacaccggtagcacacaagaacaaaaatgataacgtatcttccatacttgtctcttttaattgttaatactatttatttgttttccgccctactatatgccaaagttgtgccaaaaaatcgagtttatgcacaatatattgtttatcagttatataatcaaaaaaataatattattatgtaatatgctcaatccttttcaaaatgaaaatatccttttcattttgaaaaggtatataaaaaggcaagctgcctgttttaggtaacctaccgggtatgcaagaacaaagtgttccacattatagtccataggcttccatcttcttataaagtgtggttaagcctatcccaagaagacgagctgcttcgggtttgtatccgttggtatgttggagaactttctgaatgaggtgcttttcaacgctgattaggtccaattcaatattattccccatattttcagataattgacatttcctttccatggacatcgttttatggctgccatatattttttatgatcactttaaatctcaccaaaatctttagatatctgccctgcacagacaggcttccaacaatcgaaatttctctttttagctaaaatcgtgttattgattataggcaattcgcaactttcgctgatatataaaatagcatgtccccgagctgttgttttcaattgttttcttaatgtgttccaagcttctgtatcagaaataaaatattgcgatgcggtagactccgtttcatacaccagtttgtattcattcagcaccaattcattttcctgatttgtcttcttttgaggatagcataaataggcaattcctgtcaaaaggatgattcctgtaaaagtattcagcagatatttaaaataataatcattttcgaagaaatagaattcattgatgttaccacatatacatacgctagccacaaacagtaatattaccgttatccgttgcttcaaaaatttcatccgcatattcttttccatttgtatcctaatttttgaaattaaatcttttaaataagccgtgaataaattatatccacggctcaaaaagaaaaaaacaattcaaatctttacataatgaatggagaaaaagattttggtacacataaaacaactttaattgcaataatatataatatgaaacttatatccttctatgggcaaccaaatacttcttgcaaggccaccatttttcaatcctgtttttcaaaatgaaaaaatatccaaaaacaccaatccagcttgttactagtaacagaacgataatcttgtttttgatcctttgaggaacatctttttttattaaattgctgattgcccatacagaggcaagcgagcctaattgataaataaaaaataccattttgtttctttgttgttctacattgtttcttatagcagacaaccgaagatgaatattaatgatactttcttcggaaatctaaactgataaagataatgccaaaatcagaccaatttaagaacaataaacataaatcactatatatcaatagattaaaaatatcaattctaaattgaaagtaaaaaaaacaactaaaatgaaaaacactttttcattttggtaatattacttaggcttccctatttgcaaacatctgtttatcaatgacaaatacaaattggtatggattttgctttgtgttgtatataatatttcaaatatgagattatttatcatttcgaataggttgcctgtaaaagttacacgttcctccgatggaaaatttgttttttcacggagcgaaggagggctggctacaggtttgaagtcattggacgttgattgtgaaaaacattggattggttggcctggcgtctgcgtagaacaaaagacggaaaaagatgacatttgcagtcaattggaaaaaaataattatcatccggtattcttatccgacaggcagtatgaaaattactacgaaggatatagcaacagtaccctatggcccctctgtcattacttttttgcttatacgttatataaaaagaacttttgggaatcatatagggaagtcaatgctgttttttgtgaagagatatctcggatagttgaacctaatgattgggtttgggtacaggactatcagttaatgctgttgccgggcatgctccgtgagaagtttcccaaccttcatatcgggtatttccaccatattccgttcccttcacatgaacttttccggattctgcccgaaagggtcgagatcctgaacggacttttgggagccgactttgtcgcttttcacattcacgattatatgcgtcatttcatcagtgcgacggaacgcatccttcataagaatttcaatctggatgaagttcaaatgaatgatcgtgtaacccgtgtggatgcattaccgatggggataaactatgatctttatcacaatgtgatagctgatgacaaagtccaccacgcagtagagaaaacacgacttctatttggagatcataagttaatcatatcggtagaccgactggattacagcaaaggaatattgcaccgtctttacggattcgcctcttttttgaaaaatcatccggaatatcacgggaaagtgacattggcgatggttatcgtcccctctcgcgaccatgtaggcagttatgccgaattgaaaaccaaaatagacgaggagatcggttctatcaatggaacttactctaccatgaattggactccggtatgttatttttatcacggtttctcttttgaggaattagtagcgatgtattatgttgccgatatagccttggtaacccctttgcgcgatggtatgaatcttgtggcaaaagagtatgtcgctaccaaacaagataatccgggggtactcattttaagtgaaatggccggtgcttcggttgaattgtctgatgctttattgattaatccaaacgacacggaccagatcgaacaagccatttgccgtgcattgaaaatgccattggaggaacaaagagaaaggcttcagcgaatgcaagccatcctttcggttcaaaccgtaaacaaatgggctgcggatttcatgagagaatggcggcagaccgcagagaaaaacaaacgattacaaaagaaaaagatctccgcacaagaccagaacgaaatcaaaacattatatgaccaagcgaaaaagcgcttgattttgctggattacgacggaacattaactgcattcaaaaatcatccggaagatgcagttccaacacctgcattacgagacctgttacagcgtttttgttctgactctcggaatcatgtaaccattaatagcgggcgggaccactatacattggagaaatggctgggagatcttcctctgtcttttgccgccgagcatggtgcattttacaaggaaaaaggcgcatggcataaaaacataggcaatcgagagtgggattcggagctattgtttattctaaatttgtttgtaagcaaaaccccgtactctcatcttgagacaaaagaagctgctcttgcctggcattatagagaatcggacgcctggctgggagagctgagagcgcaacagctaacaaaggctataatgcctgtttgcctgaaaaagggattacaaatcatgcagggcaacaaagtcgtggaaataaaatctccagaatgcacaaaaggttcggaagtagctcgcctattattggcttcccgctatgattttatactagcaatgggagatgacacgacggatgaggatatgttccgggctcttccagtatccgccataacagttaaagttggaattgtatctgaaaaagccaaatacaatctgtcctcgcaggaagaagtattgccttttttggaaaaactgtcgggtgaaggtgttagttacggaacgacttccaaaagcataaaaggtcaactgaaagccaccgttgatttttttaaaggattgtggacaaataaaaaataatttttatggacaagttaaattacggagtaataggaaattgctgcactgcggctttgatttcggataaaggcagtatagattggttatgtttccctaacttcgactcaccttccatctttgcatcattgctcgatcgggagaaagggggatatttcggcttcgaggtttctccggattatcaaatatcgcaatcgtatgttcctcatacaaatattctttcgaccaacttcgtatcagaagaaaatgaatttgccgttgtagatttcatgccttgttaccatctgagcgatgcgagcaattgttatcgtccggcagagatctaccgatatatccgcagaatcaaaggtactccccgttttaaaatcaactatgagccggctccggactatgcccgtggaaagacaattttcaacacgacctcggaatatatagagacctactctacttctaacagcaaagataggcaatatctttattcctcactacctttgcacaacatcttggaacagaaagaaatcgtactggctaaggacgagttcttgctactttcatataacgagaaagtaatacctgtcaacattgagcgtgagaaactggaatactgccggacgctggtttattggttgaattggactgaccgaaccaagaagtttacggtctataacgatgtcattgagcgaagtctcctagttttaaaattgatgtctttttataatggagccgtattggcggccataacaactagcctaccggaaacgatcggagaagtccgtaactgggattatcgtttttgttggctgcgcgacgcctccatgtccattgaaactttgttccagataggccatgtggaagccgcaaggcggttcatgagatttgtccagtctacttttgtttctcaacacgatacttaccagatcatgtacggtattcgcggagaaagaaaattgacggaagttattctgggacatctttccggttataagaactcacgacccgttcggatcggtaatgatgcttaccaccagcttcaaaatgactcgttcggctatttaatggacctgatctaccaatactatcgtttgatgcccggtacattggacgaggtggaagatatgtgggaaatggtaaaaagtatcctgacgaatgtgatgattgactggaaaaaaccagacaaaggcatttgggaaattagaggaaaaggacagcattttgtttcctccaaagttatgtgctgggtcgcattagacaggggagctcgtattgcagatttattaaacaaaccgacataccggagacgttggtcggaagaagcgaccgtaatcaaagaaaatgtcatgaaaaacggttggaaagaagagatgcaaagtttctcgcaaacctacggtaattccgaccttgatgcgtccttgttgttaatggaaccgtacggatttatcgatccgagagacatacgctaccataaaactgtgcaagcgataaagaatgcgttactttacaaagggttgatgtaccgttataaatctcatgatgatttcggacttccctcttccgcctttactatttgtacgttctggctcattcgtgctctttatgtcattggagaaaaagaagaagcacgtagtctgtttgaggaaatgcttcataattcaaatcacttgggacttttcagtgaagacattgattttgaaaccaaggagcaactggggaattttcctcaagcatattcccatttggcactagtcaataccgctatattgttttcggaagaggacatacgactgttttttaaataaaccttctgtatctctttcattttggaaatattttttcactatgcaaggggctacactaataaacgcatgaagcatactccatattgataacttcaagacttttataagtaaattaccattatagaccggccttaacccatatttttctttatccaatcgtatccacatatagaaggaaagcatcataaaggagcctatctctgccaaagaagaggcaattgccgcccccgagattcctaattccctagtgaatatcaaataaaaatttaaaggaatattgattaataccgctatggcagcagcccaagatagagcttttgtatgcgttatccccactaaaaaagaacgtatcgctaaaaatgggaatgaaaacaacaatccaaagctacgccaatccaagtataggattaccgttcgataaatatccgaggaaacgatcagcttctttaatataaatggggaaaccgtatgaatgagaaggtaaagaaagatagccaatcccaaaaggaaaaataagccttgaaaaaaagtcttgccggtttccttgtaatcttgctctccattccttcgagctaccattacttgcaacccaatgctaaatccaaaaccaagcatataaatcgccaaataataaattccggcgatagcggacgctcctaattctatctctccaacgtggcctaagaaaacagcatccgtaatattgattaattgttccattaagatgctcatcattacaggaaagttgatgagccatatttgtttatatgtataattcattgctcaactgtataatagtacgatacaacataccgcttttatgcagtatgttatttcgtaatccataaaataaaaggatataaaatctccgtgacaaataaagctgtatttgtcaaatagctgaatagctttattggatagggctaaaagaaaaaacggctaaatagacgtctctatccaaccgttcaaaagatcttcgcgataatcttttgtgctcacagtcaaggttaaactcgaaaaacatataacttcaaaatgaatttataacatcattttgttttgatgttggcaaaggtaagcctttatttgtaaataacaattttttatcatgttttttttactattatatctttttttcttctctagaatattttcgttttaatttatggtctcttttgtgctcggatattcaaaaaaacacaatggaaagttcaagagatgaaagcaggacataaaaagggtgtgtcatgacacaccctcttgtgaaaccataaaaaagattttcagccacaatggaaataagtattgaccagcttcaacatctcttccggattattctctaggtccttgcgtaaagaagcgtcatcataagattccagtttatggatgatgccgtctatcatactcggactaaacacattatatttttcaaaaacagcacgctgttgtcttaaacgggcggctgaggctgcgcaactgtctgggagttgatccaatgtctttaggcgatcttgattctcttccttatgaatattcacgtttacataagtcttctcagcgatctccaaagcatcgtcgatctcaaaaccatggcggcacgcaactgccaatcctgccaataattggtataaatcagcggagccatccggtgagcgcatctcgaccgtttgcttttggctcgtatcataatggctggcaggttccaatgggttcgccaaagcacacatgtccgtttttgcggcccaacctagcggaacacgaactaaaactgaacgattccgatctccccaacaaatattcgtaggtgcttcttggtgtggaaccaagcggaaatatgaggttgggttcgtattcccaaaagccgtaatagaggaagctaagcacatcattccagcgatagccttacgggcggtttcggataagataccattcgctaacatctgattcttgccatctttcatgatacgcatatggacatgcagaccggaacctgcttttcccaccgtaattttcggagcgaaagtgatgttatatccatattcatgcgctagattgcggatcgcccattttgcgatcatcaattgatctgctgcattttccgcaggacatggtaagaactcgatctcattttgctcatagatcaaaccatttaacgtaaagttaccaacttctgaatgaccatatttaatttgtcccccggcttgcgctatgcagtgcatgcactccgtccggaactcattgaacttagcgtaaggagcggattcatgataacctttttggtcggtagcagggaaaacgccttcatccggtgcgattacgtaatattctaattcacccattgcctcaaattccattcccgtcacctcatgaaaagccttacaagctttatgcaaggtatattccggggaactttctaagggttctccatccttattgaagaatgagcaaagcatggtaagcgtaggtaattccgcaaacggatcctcgaaagccgtacggaaacggggcaccacatacaggtcactacttcccgcctcgataaacgagaaaagactagagccatccacacgctcaccgcaagtcaagatcgcatccagataggccgcattgttgattacaaagtttagtgttttcaaacgtccgtcgcctgcaggatacataaaattaaccatctggatatctttctcatagatataacggataatgtcctctttcgtaaactcggacgctggcttttgtaaaaactccactaatacgttgggagtcatttctagttctttgttcatgtcttatattgattatgtttatagtgtagagaaaaactttcctttggaactgctaaccggaatcaagctagagatcgcttcagcaacctctataggtcggtcagactctatgatgtccacaccttgacggatgatcatacggtatgcttcagcacgactttcgggtgtggatagtttatcgtcggagggagcggtagatatcatgcacatgacacctctttcatgtaacatatcgatcacctcacggacttcgggggtaatcttcggacctacgtaagccatgatatgattccaaggtataccgttatcctcatagtcttgaaccgcctctttcgttttcacgaaagcctcaaacatgaaattcggatttttctcgtaaaagaaacgagccgaggcaccatcatgaaccgtaatcattacataaggttccgcttgcatatcggtaatcaactgagcagtgcgctccatcggaacatccttcttatcaaggattaggattgtttttccacgggcccaacgaatcgcttcctctaaagtcgggatacgatagtttgtgatatttccttcgggatccttcaaacggaaattttgcaattcttcccaagtataatcagaaactttcccagtcccattactggtacgctccagtgtatcatcgtggaaaaggacgataacactatctttggttaacctcggatctatctcgaacgtggcaggagtataagagagggtattttcaaaggtttccatactgttctcaggatagccttttccccgtccacctcggtgtccactaattaaaggaattcggtcatcggcatattggtagaaagatatcaaatcatctacatttgatatctgtagcgtattcattccgttgtattcaagctcctcctttggcgtgttcaatacgcaagaaccacaaagcagggccagcattaaaaatctggcggataaattgattttcatttcacgatcgtattttaggtgaatgattctttctatccgccaaacttacacaaaataaatgattttacagagttagcaccttaatattcgtcaactttctggtctacacggaacttatccaaacgtgcttgcaggcgagtttggatatcagcatattccggattatcgtataaattattcagctcattcggatcactttgcaaatcgtaaagctcattgcaattaatcgcgtcattatgttcattcttctctccatagaaatgaatcaatttataacgactgtcacgtacgccatcgtggcgacgtaccatatggatcgcaggataatcataataatgataatatagatactcacgccaatctcttggtgtctcgcctccaaacaaggggactaaagaagttcctaccatataatcaggtttctcgataccggctatatccagataagtcggggcatagtcaatgttctgtactaaggccgtacattcacttcccgccttgattttagcaggataacggataatcaacggcgtacggaaagattcctcatacatgaaacgtttgtcgaaccagccatgttcacccatgtaaaaaccttgatccgaggtataaacgatcacggtattatccataagcccttctttttccaaataggcgatcaaacgccccacttcatcatcaatagatttgatgcaacgtacgtaatccttgatataacgttgatatttccatttaaccaaatcctcgcctttcaggttctcgttaatgaatttttcgttgcggggcttataagaagcgatccaagcctcccgttgttccggggtcatacgatccaaagaggcctgccaaccatcaatattccattcctttttataagcctccttatctttaagctcatctaccttcaaatcataaaccaaagtcatatttttgtctatactcatctcttgtgtacgtgcggcatcgcaacgagtggcataattatcattgaaagtatctggatatgggaactctacatcctcatataaatccatatatttcgtatccggcatccagttacgatgtggagccttatggtgaaccagcaggcagaaaggcttatccttatccctctcttccaaaaactcgatagcgtgatcggtcgtaagggttgtcgcatatccctcttcttttacatacttgccattcgattctttgcttttaaactccggattataataatctccctgatcccataacacatgataataatcaaaacctttcggctcacattgcatatgccatttaccgacaacacctgtctgataaccgtgctgttgtaagatttcagagaagaatacttttgtcgtatcaataccttttcctaactgtctttgtccgttttggtgactgtaaagaccggtcatcaaacaagcacggctaggagtagacagagaattctctacgaaagcttgccggaacaacattccttctgcagccaaacgatctaaatttggtgttggtgccaatttacctagcgcatgtccataagcgctaatagtttgatacgaatgatcatccgtcatgatatggatgatattaagcggcttctctgccacttctttttgcccggttccgcatgcggagaataagaaggccggagccaagaagaccccatagttaatcgcattcttcatgtattcaaaattttaaaattacacaaacgtacaaaaaacagaaattatcaccaataatacttccgggctatctcagccatagtcggatatttactatcctcatcgtcatattgttgtttcaattccaacagttttgtcttcaactctttaatcaacgcctttttcgatgggtcgtgatacaggttcttcatttccattggatcctctttcaagtcatacaattcccattcgggagttctggactcattcttggtcccggtcattcccaacgactctccataatagaatatcaatttatagcgatccgtacggataccatagttggctgtcacgttatggtcgttatccgcattcatccaatagcggtaatacatagcctgtctccaattagctggggtctcatttctcaaattcgagcggaaactttctccctgcatttggctaggcttgtccattccggcataatccaaaaatagaggagcgaaatcgatattcaatgttatatccttattatccgtgccgggtttgatttctttcggataacggataacaaacggcatacgcaagcattcctcatacatcaatcgtttatcaaaccaaccatgttcccccaaaaaaaatccttggtctccggtatagatgacaaccgtgttttccgccaatccttgctcatccaaatagttcaagatacgccctacgttttcatcaataccagcgatacagcgcaaataatctttaatatacaattgataagcccaatggcgcaactcatcacggctcatatccgtaggtatatccgttttcacatccgtctgcctcaaatgctccatgctcatccgtagcaactccgcatactctcccttgccctcatatgtgtccaataagttctccggctccgggatcgttacatctttcaataaatccttgaaacgctcggcgggtgtccacggtctgtgaggagccttgaaatggcacatcataaagaaaggcttgctcttatctcgattttccatatatttgatagcctcacttcctatcacgtcggtagaatgccctttatacactttacccgttcggggattcgcatgcggatcattcccccatgtacctttttctataagcatcgggtcattataacggccctgtccaggcaagatattgtaataatcaaaacctgtaggttccgcatgcaaatgccatttaccgaatatagcggtttgatatcctgcttgctgcaagcatttcgctacattcggatgatccggatctaatggatcttgcaaagtatatacaccattcttttggctatattgtcctgtgataatcgctccacggctcggggtactgattgagttcgtcacaaaacaattcctcaatattgcgccctcatgcgctattcgatcaatattgggggtcggtaagaccgttgataaaattccaccataagcacttaccgcctgcgaagcatgatcgtcagacatgatataaataatattcggtgtcctattattctgtgccatggctgtttgaacagcactaaagtcatatagacaaatgcttgataataaaatgtatttgtatttcatgatatttatattgatttattatagcctaacatctaactaataaactttcaaaagatttgcaaatctattaataaaaaggggaatgtcatcatcctcgcttccataacgaactatagattttggcattccctcttaagtcatactttctacaaatcaataatacccttgattcctatgatctgtgtgaggtttcactgtccgtttcaatgggatattcattccgtctgtagattctaaccaatcataaatttgagcattcagttgtttgatagtttctttatattcaggttccgcaattaaattcgtggtttcatacggatctttttgcaagtcatagaactcattcgtatcccaaaccccatgataacggatatacttataacgatcagtacggataccatgcatcgttggtgtctgcggaaattcatattcccagtaatactcatagaaaatatggtctctccaatccaccttctctcccttaagcaagggcaggaaagaatatcccaccatctgctcagccttttccaaacccgcacaagccataatcgtaggagcgacatccacattttgtaccatattctctatcaccttacctccctcaaacatactggggcaacgaaccaacataggaactcgcacagattcctcgtagaactgtctcttgtcgatcaatccatgttctccccacgcaaagccattatcacccatgtaaataaccaacgtgttatcatctaaccctgcttctttcagataatccaagacagaaccgatactttcatccacagaacgcaaggtctcacaatatttgcgaacttgaacatcccaaggacggccatggtaggaatagtccaccccatgccaactttctctttgacttttcacccaatccggagccattttttctccataatactcttttccaaacgcagcctttcctgttttcttatcaatagtcggcaactctttaatgccataatgaggcgtattgaagttcggaggcaataccaattccttatctttataacaatccttatggcgctttgcggctgaaaaattgtcgtgcacacccttatgagacaaatagacaaagaacggtttatccgcttgtttttgttccttcatgaattggatcgcatggtcggtcaagagatccgtaacataggtgctgtctttatactgtatccattccccatttacatttatgccgggattataatattccccctgccctttgaatccttcccaatgatcaaatccaggctgaggagctcccgagtcatttcccatgtgccattttccaaagaaagcagttttatatccgctttcttgcaaatattgagggaaaaataccagcccttccggaagcggagcggaattatctaccaccttatggctatgcgaatacataccggtcaagatagaagcccggctgggagaagaaagagaagttgtgacgaatgcatttttgatatgcgctccttccttggccatccgatccatattaggagtttccagccaagggatcgtatgcatgaatcccatgtagtcatatcgatgatcgtccgaaagaataaagacaacatttaatggcttcgttttttttgaagtattgtctgcttcctgatttttaggctggcaggccaggcattgacttacgatagtcaatgataacaaggtattattgatatttgtattcatattgataaaagttgaggagctgtaagttttacagctccaattaacattttattaccaacccggattttgtgttagttcaggattcaaatccaattcccgttgaggaatcggcatgaggatcatgtgatcctttatattactagcaatatccgtcttattcttttcggcaactttcgcttcgtatgcgctatgctctttcatccgttttatgaatgtacctgtacgtacgaggtcgaaccaacgatgtccttctatcggaaattccaaaaagcgctcgtttagtatcgcctcccgaaatgcgtctttggacaagcccgaataattaccggaagaatcgccaaatgcacgttctcgaacacggttaagaacttggtgggccttcgcagactctccgatttcatttaaagcctcagcatacataagcaaagcatctgaataacggatgatatgcatgttgatttcacagaatttaatagcagttataccttcttgccaatacttgccaaataaagggatactagatattaactctttcccattttgcgggtttgtataatgagttcttagatttactgcttttcgcttgtcattttcattatacttatcatttaattctattgtcgggatatcagcttcattagatccattaacaccgacaggttcaggaatagaatatttcggtccaatcatactcatctcatcatttttaggaaacggatcttgtttatattctatataaagcacggcttcttttcctgcttcagtttccaagttccaattgtcaccatagttcacatgtaagccatatccataagcaccttcttgttcaacaacctctgccagtttttccttcgctttggaataatcacctttcgtcaaatacacctttcccgctaaaatcttggcagcaccttttgtcgcacgcccaatatccgtagtcccatattctaagggataaggaagggcattttccgcatctgtcaaatcagatagaatctgttcatagatctgttctttcgcaactcttggtcccatagcatcatctattgtctctaattgagtcaccaaaggaacatctccaaaaaagcggactaaattgaaataataaagagcacgcaagaatttcgcctctgctataaatcttttttgcaaatcagggttcatggtaactgatggaatattattaacagctgcattcgctttcattatacccatatagttgttttgccacatatctctaataaaagtattttccggagtgtgacgtaagaattccaaattctgcaaaaaagcattaggcatacccaagccatttttcatcccatcgcatgtaagatcgcataacatatacatatgtcgattatagatactatgaagctgttgataagttgcatcaactgccgcttgagcatctttctggttcgaatagaaattatccacaaccaatctatctattggtttttcatccaaaaaagaacattgtatattgaataatgagaacataaatatacaactaaacattatgacttttttcatgataatacaatttaactattacttaatatcaagttttacaccaaacatgaatgtacgagattgaggataaccgccgaaatcttcgcctgcctcaagtgttgaggctcctctataactaacttccggatcatatcctctgtacttcgtccatgtcaataggttttgtcctgttacatataaacgtaggccttgaatatgtttcatgtttatcttagggaaactataagacaatgagagagtttttagtttcaaataagaaccatcttctataaatcgatcacttgccaatatggctctgtttgttgtcgcctttggatagatattactcggattctccggagtccagcgatttaccatgtctgcgtaagcattttgtccacctgttggattctccaattccatggcattgtaattaagaatcttattcccataggaatattgcaagaatacattaagttcaaaacccttataagcaaacgtattcgttaatcctccgaaaaatttaggattagcatctcctaatatttctcggtcattagcggcatcaaccttcccatcgccatttaaatccttatatctacgcaaaccaaccccaattggagaagctgaagaggtttgttgcttacactcttcctcattttggaaaatgccatcaaaacgatatccatagaaaacacctataggttcaccagcaattaagcggcgtacagaacccgtttttatatgtccatcaccttctgccatctccttatagtcttctcctcctaattcaagcactttatttctattaaaagatatattaaatgcggttgtccagctaaaaggacctgttaaattatcactttctatagataattcatatccttgattttctatactccctatatttttcaacatggtttgatatccggatgtagcaggaacagcgacactatacagtaagtctgttgtttttttcttataatagtctgtcgtaatacgtactctattattgaataaaccaagatctaaaccaatatcaaattgtccggtacgttcccatttcagatcaggattaggaatcttattggggaagaaaccagatacaagttgattgcctaaaatccaattacttgtccctaacgtagccaaagattcatatactccaatctccgtatttcctgtaaaaccatagctagctcttaacttcaggttggaaattgtctcttttactggctccataaaagcttcttctgatatacgccatccagcagacgcggaaggaaagaaaccatatttattgtttgccccaaaacgagaggaaccatcaacacgggcattcacggagaataaatacttatgcttcaatgtataattaacacgtgctaaatacgacatcaaactccattgcatggcgttggattcaggtttgttataaaccgagccggcacctaaattgttatattccattacatcattcacgaaattggaggatgaggccattacatattccgtattgtttttttgcatcgtaaaacctccaagtaaattcaaatcatgatcttccgcaaatgttttattccaagtcaatgtgttttcatttagccaatttatacttttgtttattcctatttgagcggttgcggttccatttgcttgataaatagtggacggtgtatatcggtttgttttgtggtacataatatcagtacctagagaaacctttaagcgaagatccgggataatctcccattgcgcataaatatctccaagtaaacgagaagtcgcattgttgaattttcgttcttttgcggtcgcaactggatttggaactaatatgcctggaacattaacttgagtatacgcacctgttaactcatcctcatacacaggttgtatcggattcattcttagcgcaccggaaatggtaccatcttctcctcctgtgtctgtcgctacggaattactaattgtatggctggcggtcatgtgtgttcccacgctaaaattcttgaatattttacgatctaaattcaggcgtatggaataacgcttgaaatcagagttgatgacaattcccttctgatctgagtaattgcccgatattgcatattgtgtcttctcgtcaccacccgaaaaacttaattgatatgtttgcgtacttcctccacgaaatatctcgtcttgccaatccgtcccattaccaatctttgcgatctcagataaagccgtagcatcataatagggttttaatccatcatttgtataagcctcattcactaatttcgcataatcttgcgcattcatgacatctatcttcttggatacgtttgatattccaaaacttgcctcaaaagagataatatcccgtccctttttaccgcttttcgttgtaatcaacacgacaccatttgccgcacgtgctccatagatcgccgtggcggcggcatctttcaagatctctatagactcaatatctgatgggtttacagtagatagaccactcatctgtgtcttaccccccgtattaccgaaaccactaccactataaacagggaaaccatcgataacatatagaggctcgtttcctccttgcaaagaactactgccacgtacccggatagaagctacggctcccggcataccagaggtttgtattacttgcacaccagaggcacgccctaccaagccttgatcgatagaagtcatgggcgtttgctgtaattccgctgttttaacagaggatacagaaccagtcaaatcactcttcttcacagaaccgtagccaatgacaacaacctcatcaatattttgggtatcctctgttagttggattttaagggaatgttgtttgccaattttcacctctttggtcatatagccaatataggatatcaaaagtatatccttttccgatgcgtctaaactgaaacgtccgtccatatcggatatgctacccgtagaggaaccttttacgacgacattagcgccaatgataggtatgttcgcttgatcggtaatgatacctgtgatcttaccatcctgctggttcatccgaggccgttcatttttcttgtagattatgatatgtttatcatcaatcgtataagacaagccttgtttatcaagaataccatgcaatatttggttgatgctttgtctatctgccttcacagagattttctcattgagattaatctcatcattcttgtaccagaaggagtattcactttgatgtttgatctcttcaagcgcctccgagatagtaacattgtgcagattcaatgatatttccgctacttgagagtaacccgttttcgcggatgcgcaaaataagctgagcatacatagtacaacagatagtctcatgatgttatatgttttttttaggttaacattaggcatataatgccttgtgtgtgaaattaatttcatacttttgcaatgatttaaagtttgtaattgtgttgcgataattcagacttgagtctttagaaacggaagatgttggtagcattttccgtttcgcatctttctccattctcttttttctatttcataggcatatcgatttaaagtttaaactcattggatttattttttcgagatcgtaatttgatccccttctatctcatatcttataggtcgattagcggtcatgactcggagtatttggtctatgttctctcctcgtacgaaatcaccggtgaaagcagcctttctcaagtcatccccgagtatctggattctcacgttaaagctcctttccagttgcttagcgattttctctagtggataattggtgaaatagaatttaccacaaacccacgccgtataactttgtaatctcacctctctcttgataaagcgatgtgaggctttcatatattttatttgctgtcccggcattatctggatgagatttttagtgtcaagtccgacaccgactttcccttccgctaaagtcacctctatattatcatcgtcatcataggccttcacattaaacttcgttcctaatactttcaccttaacattttcagcgctaacgataaagggatgctccttgtcgtgcgatacctcgaagaatgcctcaccgttcacctttacctccctctgcccggagacgaaagctgccggataactcaatgttgtaccggcattgaggatcactttcgtgccgtcagacaggactacggaggatcgcattcccatcggattcaccatctctatcatttggctgttcagtttcttgtaaccttcatggaaagagatataattggagatgccgaacaaaagcgtgacggaggcggcgaccgcagatattctcaaccaaaaccttctgcgcaagctgcgttcgatacggttgttgacctcaaggaagatatcttccctcatttcgtcacccatttgctttatgatctcttttcttgtctccatatttcgtctttcttataataaggagtaaggatcggtgaaattcgtttaaagagaaagacattttttttaaaatgtttgaaatatgtcctagatgcataaaacatccaaataattgtcgtgtagaaagtcattttcacctagtattactcccttctgtgtagaatatatactttaagtgctataggatatatacttcaagtgctttggaatatatacttcattggctaatttgattttattggaaaatggatattaatatgaaaacaaacgaaatatcaggaaaatccgatttcaaccgttttattaacttctccaccgcaatcttcatttgcactcggaccgtactctcttggatggataggattttagcgacctccttggtacttaatccttcctcacggatcatcaagaatattaggcgacatttttcgggaagctcatcaattgctagattaagaagttcccgcatttcttgcgattccaacataccctcaggagtagcttcttcctctggttcaaatgagcataactgatccatctggattttattgacactattgcttcttgaaatatgacgaagcgcttcgttgcgtaccgttatatacaagtaagtatctatattgtctatctcttttaagcgtgcttttgatttccaaatggaaaagaacacgtcggacacgacctccttgcaagcctctttctctccaaggcaataatacgcaaaacggaatacctgatcgtaatacaaattataaaagtgctcaaatgcccctctgccgtctgaagaaacagaggataacaagttcataatattttgtttagatactttcatgcccttttatacttagagaaaaagcgggttgtcgcccacacttcgtaaggtatcgccagagacctatgcacacgtagacaagcaacccgcagatatagcgagggcttgtgccttgtgtgctgttaaaactggcgatttcaacgaagtaaggcacttccaaaattttcacgatacaaatataaggtttttatcacatttaaatctctttaaagcgtactattgatttctgtgagatcattatctttgtacgaaacatatcggtgaaattatggacgagaaagtgctcgagaaattgaaaatcttggccgagtcggcaaaatatgacgtatcctgcgcttccagcggaacctcccgttcgcataagagcggggctataggaagtgccgcgggatggggcatttgccatagtttcgctgaggacggacggtgcatctcgcttttaaagatcatgctgacgaattattgtatgtatgattgcgcctactgcatcaaccggcgaagtaatgatttgccgagggctacactctccgttaccgagttggtgaatcttacgatcgagttttaccggcgtaattacattgaaggattgtttttaagctccggcgtggtccgaaacccggattacacgatggaacggttggtgagagccatcaaggatttgcgcctcgtacatcacttcaatggatacatacatatgaagagtatccccggagccagccaagaattggtaaatgaggctgggctttacgccgatcgtttaagcgtgaatatagagatcccgaatgaggcgagcttgcggactctagctccggaaaaggattttaaaagcgtatttgcccctatgcgttatatccaacaaggtgtattacaaagcgccgaggaacgcaagcgtttccggtatgccccacgattcgctcccgccgggcaaagcacgcagatgatcgttggcgctacggcggataccgacaaggatatacttcgtctatcatcggccttatatcagagacctacgatgaagcgtgtttactattcgggattcattccggtaaatgcgtatgataaccgtcttccggcacttaccacgcctccgctggtccgtgagaatcgtttatatcaagcggattggttattgcgtttttatcaattcaaggtagatgagattgtcaatgacgcatatccggatctggatctagacgtggacccgaagttggcttgggccctgcggcatccggaagtcttcccggtagatatcaataaagcggattacgagatgcttcttcgggttccgggaattggcgtgaaatcggcaaagatcataatcgtttcccggcgttacgctaatctcggttcagagcagttgaagaaaataggagtggtcatgaaaaaggctagctattttattacttgccgggaactcccgacgcagaccgtgaatgaggtcagccctgaaaccgtccggcaactattgacgagaaagagcggaaagaaagtagacgatcggcagcttatactgccttttatagattaacgcctgttttataagaaggattgataatgattatatttgtttacgacaagacttttgagggattgcttaccgccgtattcgatgcctattcccgccggacttttccggatttgttattagccgagggcgagccatttccattgttctatgacgaggcgatccggatttatacggacgaccggaaagcagaacgggtatggaaagggcttgagaagaaaatctccaagtcttctctttccgggttgacggtaacttggttgtcggaattaccggaagtagacctgttgttattcagatatatccgcaaagcgatcgatgctccagctacgattgagttcaatcttggtgacccggacatattggaaacggccaagatctggaagaaagtaaacaacgaacgcttgcgagtgatgcaattctttcgtttccaaaaagcggcggatggaacttactttgccgccatcgcacctatatataacgtattacctttggtattaccttatgcgcaagaccgtttcgctgatcagcaatggctcatttacgacttaaaaagagagtatggatattattatgatcttaacgatacgatagaagtccgtttcgaagagaaagattcacacttattgaccggattgctcagtgaggatatcatggataaggatgagaaactttttcaaagtatgtggaaagagtattttaagtctatcgctatcaaggagcgtttaaacccacggcttcatcgccaacatatgccggctcgtttttggaaatatatgccggagaagagataatagtataattgctattaatcagccaattacagtttttgttaatttcattatcgaaaaactaaagttttttcagcaggaaactagagtttctccattggaaaacttttgtttcatctaaggaaaactaaaatttcgtgctatagaaaaaaatgtttctctcatataaaaccagcctgttatttaacgaaaaagggatgagcttaatatcaagtccatcccttcttattacaatcaacacgtttctcttatagctcacgaatccagatattacggaagctgatcggctcgctaggatcgccatggctctgtaggatgatagggcctgcgccatgtttcttcacttgtgggaaaccgatccactctgtcgtacccaatatcgtcgtatggttctgcaaaaccacgccgttctggataaccgttacggttggatgcgtgcgataagaaccatcttccttgaaagtgggggcggtataaatgatatcgtacacgttccattcgcccggtttacgcatggcgttggccaaaggaatggattgtttgtagatactacccgtctggccgttcacgtaagtcgggttattgtagcagtctaacacttgaacctcatacatcccttgcaggaaaataccgctgttacctctcgactggctctctccagtgatattcgtcgggacctgccactcgatgtgcatctggaaatcgttgaatttctgtttggtctggatatcacctttcttcttgtttacggtaaaaacgccatcatgtacatcccattcggccgcaccgccttttacgctctcccaagcggaaagatccttgccgtcaaacaaaacgatagcgtcggaaggagccgtgaaacctccaccttttaagtctgtacccggagtgacaacgggaggaaccggttcgtaaaactcggacatctcatgcgtgataccggcataacctgtaggcatcttgaactcttttttcttgtcttgagcaacaacggtaacgcaacccgctaaagcgaaagccgcaactgtaagcaatcttttgttcatggtctaaaatgatttattagttagttaacatttcttgctgcaaatataccgttttttgccgaaacagataacgatttgtcagaaatcttattgattatgatcaaataatcttttctcggccaactgctcaaacttggtgttcggacgaccgtaattgcaatacggataaatacttataccgcctctcggtgtgaatataccagtaacttcgatatatttcggatccattaattttatcaagtccttcatgataatattcacgcaatcctcatgaaacgccccatggttgcggaagctgaataagtaaagcttcaagctcttgctctctaccattttcacgtcggggatataatcgatatgaatcgtagcgaaatccggttgtccggtaatcgggcagagactggtgaattccgggcaattaaaccgtacccaataatcatttccttgatgcttgttcgtaaaagcctccaatacctccggagcgtaatcctgtttatatacggtagagccacctaataaatgcaactctccttcttgttttctctcgtccatttctttcatttacttttgattctcttctttccttttcagatatttctccaatccgtccttacgaagtttgcaagccggacaatgcccacatccctcagccataacaccgttatagcaagtcagcgtctgcgtacgtactagatcaaagacgcccagctcgtccgacaattcccagacttcgctcttatcccggtccataagtggggtatgaattacgaattgctcatccatcgccagatttaatgttacgttaagagaacgcacgaacgtatcccggcaatccggataaccactataatcagcctcggagacacccgttaccaaatgataaatccccttaccacgggctaagatagcggcgaaagtaaggaataccatattacggccgggcacaaacgtattcggatagctatcctccggcttctcttgatccatctctatgctcgcattcgtaagcgagcaattgggatctaactggctgataagcgatacgtccaataactgaaaaggtacgtccgcatccgcggcgatctttcgagcgacctctatttccaaggaatgtttctgtccgtatgtgaagcatacggcctctacacgtgaaaaatgcttcttcgcccagaaaaggcaagtcgtggaatcttgtccacccgagaagcataccaaagcggcatcttgttgtttcatatctttcttgtttttaatacgtggtttagcaagcacacggaaaagacatcttttcagccacaaagatacgcttttttttaattctttcgagcggcgataagcaacatcatcggacggcgaagttcgtctcgcatcccgggaaccgtatccagcatcgattcgtccggttgaggctccaccagatgggtgatacagaaacccgccttgatcaatccgttcacgtaagtcgtaagtgtcttatgatatttggttacatcctctcccaaaaaacgagcatgccggattccctcttgaaaataatgatccaccggccaatgcgcaggtttcccttccgaatcgtaaatccaatcttgattgccataagcagtaaaaacgggatgttccacagagaagacaaagacaccctcttccgttaaacatttatatacctctgtacaaaccgtatcgaacgactcgagataatggaatgtcaaggagctgatcacgatgtcaaaagaatttggagcaaaatcaaaatcctcgattgctattcttttatattcgatcaacggggaggaatttatctcccgtgccttgtctaacatcttcccggaaaggtcaatgcctaaagcgaaggtcgcccctcgctctatggcatatcgacaatgccagccaaaaccacaccctaaatccaatacacgctttccgttaaaatcaggcaacatcttctttagctcatgccattctcctgctcctctcagcccttgtacagagcgagacatctgactgtattgactgaaaaagcgttcatcatcatacttattttctttcatattatatattgtagggatatcttggccgaagatacttatttttcgtagataccgacatgatttccttcgctatcttctaaaacggcgaagtatcctttattttccgcttcaatctttgtcttgggtataataattttaccccctttatccaatactttagataaagtgtcctcgatatcttggctattaaaatggattaagataccatccggcgaaggttgataactaggagcgtagaacaaagccccaaccacttctccttgctcgataaaacaagccatcttctctgtctcacactcgaaaaccgatagttttaaccccaaaatagtttcatagaaattgatcgctcgataaaagtctacagttggaatctcgaaaaaagcaattaaattgttcattttgttttctttttatagttactgttaatgtcctcgcgaagacatcacaaaagtagagcgtatcgtatctataggatagaagaaaaaggacatcttgatcactccgagaaataatcagaataaggagcgcataaggaaagatactctgtgggtgtatagccggaaaacagcttaaactcttttatcatatgtgactgatctgaaaacccacattcataagctagttgagcgaatgaaatggatggattctgttgtaccttaaataaagcccgttgcatcctaacgacacgaagaaactctttgggcgtagctcctacataatctaagaaaatgcggttgaactgtttagaacttaggcatgcggtttcagataactcagaaatattagttttcgcttgttcatttatttgatggaggactgcggatattcgctttaagttatattcatagccttcaaacctataaagacggtgaatcaaaaactgctcgatcaagcggatgcaagtttcatgatcatcagcctctatcacttttctggataatattgataattccaaatcttctatagcatccaccgctataagttctccataaaagaacttaaggggaagttgaaggatggctcttgccgcatacggctgaaaaacaaccgtgatcatttcaatctttccggctgacatcacatctgaaaagttgaggcattgcccacagatgaacgcttgaggctgcgattctttttttcctactaataaaagccttttacccctatgaaatactaattgtatgcagcccgttggtaaagtccgttcagatacagaaacatccgcgccatcttccagtatccaataatatcttacataaggagttaatatatgaataggctttattattttaaatgactgcatcttatagaatttaatttatcggggcaaaggtaaataagccctaatcaattctatagtaaaaaagagacattttatataatactgcgacattacgcttcaatcaactattttggggtatattcaaaactgtagtatgcttgatttcattaagcacaaaagagctttgcatcttcacgatgccatgaaccttggttaatttctcgaacacaaattgattataggcatctaaatccttaagaaccactttgacaaagaaatcataaatacctcccgtcgagtaacattccattatttcatcgatattccgtatttcttctttgaagcgttcgatatgctcatcatcgtgtacagctaaagatacattacagaaaatgatcaagggtaatcctatttttttattgtcgaccaatgccacatatccttttatatatccttcgttttctaaacgtttgattcgttcgtaaataggagtcttagagatatgaagtttctcagaaagctcttttgcattgatcttcgcgtccttttgcaaagaatgaagaatttcaatatctgtctcatcaagtagtgccatagttttttttcctgttttatttgatttaatatccccgaattagaattatagaatgcaaaacaggacaaaaataggaaaattatcgtatttaagcttgacgtataggaaaacaatcttctttaaataactttgcagcaaataaaaatctaattctaacacaattatgtttaaaagtaaagatcttctgtatcatagtatcgccatattgacagtcattatatggggaacaacgtttgtctccacaaaaatactgattaatacaggattatcaccggttgagatattgttataccgtttcgtgcttgcgtatttttgtattttgactatagcgcatcgacggttgtgggctaattgcgtaaaagatgaattcttattgttcttgtctggattatgtggtggttccctatacttcatagcggagaatacggcactgggcatcacattggcttccaacgtttcattattgatttgtacagcaccgatcattacaacggtattgtctcacctattttataaagaatctcttaggaaaggactgttatatggatctttagttgccttatttggagtcggattagttgttttcaacggcagtgttcttttaaaagtaaatccacttggtgattttctcactttagttgccgctacgatgtgggctttttactgccttatcctaaagcgtttgagtcgttcttatcccaccttgtttattacacgcaaagtatttttctatgggatactttctcttttcttctattttgcgatctaccctttaaatatcaaactagagttattgaaactgccagtcgtatatttaaatatattatttctgggtgtcatcgcctcaatgctttgttatatcatgtggaatacggcagtcagagccctcggagcatcaaaaacagccaattatatttacattgtccctctggtcaccttgataacttctgcgatttttctatcagaaactattacgatagcttctggtattggcgctttagccattattagtggagtttatatcgcagagaggtaaaaataaagaagggttactcatatgagtaaccctttgattttcagtggtgccaccaggaatcgaaccggggacacaaggattttcagtcctttgctctagagcacgtgatttgtaatctcggggtcgttggttcgaatccgacaagaggctcagataaaacacaacttaaaaggaagcttatacgtaggcttccttttttctattttagacataatatagttgcgcatttgcattaatatattaactttgctgataagaattcaaaacagcaacatcatggaagagaataagaatttacttttaaaaggcgctatgacttatggtttggccatgggtatatattgggtagtgaaatacatctttttcatcttcagcgtttcagtcccctccttgagtcttgtctattggctattgacgctcgccgtccctttcatcgcctactacatgacgaaaagatatcggcacgacatcggtggaaggatcagtttctttcatgcatggagattcggcacgatgttgtattttttcgccgcattgatcgtctcgcttgaatactttgtcttttatcagttcatcgccccacctgatttcgtggcaaatgcgatcgggcaattaacgactgcattaaaagatagccaagttaactcggatatgctcgactcgctcagcaatattcgcatctcgccaatccatatggccatacaaggaatatttaataacgtattttacggcatcatactttctataccggtagcggctctcttgtgcaggaacaattcgactggttccatcactgaaaaccgctaaaaagttaattacagacaaataatggacatatcagttgttatcccgttgtataacgaagccgagtctttacccgagttattctcgtggatagagcgggtgatgaaagaacataattatacctacgaagtcattttcgtgaatgacggtagtacggataattcttgggaagtgatcgaggagttgaaacaacgttctccacatatccggggaatcaagttccgtcgcaactacggcaagtcgccgggattgcactgcggattccagcgggctaaaggtgacgtagtcattaccatggacgccgatctacaggacagcccggatgagatacccgaactttaccggatgatcaccgaagacgggtacgatctggtatccggttggaaaaagaaaagatatgacccgttgtctaaaacgatccccacgaaattattcaacgcgacagctcgtaaattctcgggaataaagaacttacacgatttcaactgcggattgaaagcgtataagaatgttgtcattaaaaatatagaggtgtataacgatatgcaccgttacataccttatttagctaagattgccggatttcacaagattggcgagaaagtagtgaaacatcaagcccgcaagtacggaactactaaattcgggttggatcgcttcgtgaacggttatcttgatttgatcacgctttggtttacttccaaattcggaaagaaaccgatgcacttcttcggtttatggggaagcgctatgttcttcattggttttatcgctctagtaatcgtactcagcatgaaattgatctcgatgtactctggagatctaagacctttggttacaagttccccttatttctatatttcattgacagcgatgattctgggaacccagatgttcctagcgggctttatcggggagttgatttcccgtaattctccgaatcgcaataactataaaatagaggatgagatatgagtttcctagaattagcgagaaaacgttgctctatccgaaagtatgcccccaaaaacgtagagcaagaaaagattgattatatcctagaagcagctcgtttggccccttcggcggtaaattatcaaccttggtattttgtatgggttcaaagtgcggaaggaaaagctaaattacaagaatgctatccccgggaatggttcaagcaagcaccttattacttgatcgtttgcggagatcatcagcaatcttggaaacggggcgatcataaggatcatatggatatcgatacggctatcgccacggaacacatttgtttagccgctgccgaacaaggattgggtacttgttgggtttgcaatttcgacacggagctttgccgtaaacattttaaaattccggaaacgatcgagcctgttgtattgataccgttcggctatccttccgatccggcattattcgatgagactccaaagaaacgtaagcccatagaagaaattattaaacgggaatcattctagtatgttatacattgaagttctgctactagcgatcggcttatccatggatagcctagcagtatcagttaccggcggcgcagttcttaagaacaactgcaccgccggtaatattataaagatagcgagcgtgctcggtatattccaagccggaatgaccgtgatcggttatacgatgggattaggattcgaaaaatacatttgcgccttcgaccattggatcgcatttaccctcttgctttacttaggtggaaaaatgatatacgatagcacgaaggaagaggaggaagacgggaaattcgatcctctatgtaaccggacattatgcggattgggaatagcgacaagtatcgatgccctcgccgtaggaatctctctggcgatcttaaaatcaccgctcttgctgcaagcctcgactatcggtgttgtcaccttcgctatctctgccttcggtgtctatttcggtaaccgattcggcaagagaatcgacttgaagctggacctcatcggaggtttaatcttaatcggtatcggtacaaagattttgatagagcatgtattctttagctagggataccttattgaataaataaccttatacattaattaatagacatgaaaagccagcaattacgaaaactagcgccggagctggattcactccggctaggcagcggttggaaaatcgacgaattgagtaaaccgcaaatcattgtagaaagcagttacggacatagccatccgggaagcgcccatctggataaattggtggacgaggcaggaatcggtataaaggaaaaggggggacgtgccgcaaactacttcgtcactgatatttgtgatggagaggcgcagggacacgatggtatgaactactcattagtctcccgtgatatcatggccgccatgatggagattcatgtaaaagcgactcctttcgacgctggtgtctttatagccagttgcgacaaatccgtccctgcgcatttgatggcgatagcccggctagatatgcctgctatattcatgcccggtggtataatgaaagccggtcccaacctactcacgttagaacaaatcggtacctatagcgcccaatacgagcgaaaagaaataacggaagaacaattcatggtttataagcgtgacgcatgtccggattgtggagcttgctctttcatgggtaccgcctctacgatgcaagtaatggcagaagcgcttggcatcgctttaccgggctccgccttgatccccgcccatttacccgagttaaaagaaaccgcccgtaaagccggagaacatgcactcggactagcgaaagaagagttaaaaccctccgatatcatgacgatacaagcgtttgaaaatgcgatcatggtacatgccgccatagcgggttccagcaacagcctgcttcatcttccagctatcgcccacgaactgggaatccagttatcaccggatttgttcgacaagatacatcgtaagatcccctaccttttaaatatacgtcccagcggtttttggcccggcgaatatttctggtatgcgggaggcgtaccggcgatcatggaagaaatcaaagaattcctccatctcgacgtcatgactgttaccggcaaaacattggaagaaaacttaaaagatttacaactcaacggcttctataagaattgccataaatatcttcctgccctaggagtaaaggttggcgatattatcaaacctcttcatacaccgatcaaggcacaaggagccatcgctatattgaaaggaaatttagcgcccgaaggggcagtcgtaaaacattcggcgatttcaccccgcttgatgcaagtcaccctgaaagcgagggtattcgattgtgaggagaacgctattgaggcggtattacaaaagaaaatccatccgggagaagcggtatttatccgttatgaaggaccgaaaggaagtggaatgccagaaatgttttatacgacagaagcgatcgcctccgatcctgagttggtagagaccatcgcattgatcaccgacggtcgtttctccggagcgacccgaggcccggcgatcggacatgtatccccggaggcttccgaggggggaccaatcgccttggtcgaaaacgatgacttgatccgtatcgatattccagcgagaacattggatataatcggtaccgacagtattgagagaagcgtggaagagatagaaaagatcctatccgaaaggcgtgcacattggataaaaccagagtcacaatataaaaaaggaatccttgatatttatacacacaatagcgtctcccccatgaaaggggcatatatggaattttttatgtaagttcgcgacataaaatttcataatgatgcgcaagaatattaccatattagtcagcctgttgatcttatcgcatacggcttgctcggacaagggccaatatttcgaagagagtggttctgtttttcatacaagttaccacatcaaatacaaggccaagcaaatcctaaccgataagatcgacagcgagctgcaacgttttaacctctccttaaatcctttcaaccccaactccacgatcgcgaaagtcaataataacgaggatgtggaggtagacgaatggtttaccgaagtattcaataaggcggaagaaatctccaaaaaatcaggaggagcttttgatattacttgcgctccattaattaatctatggggattcggattcagtaagatggacagcgtaaccccgcagatgatcgatagcatcaaggctttcgtcggttatcaaaaagtaagattggaaggaaagaaaatcatcaaagaagatccccggattctattgaattgttcgtccatagcaaaaggttatgcttgcgatgttatcgcccgcctgctggaaaaggaaggcgtaaagaactacatggtagaaataggtggtgaggtcaccatgaaaggcgtaaatcaacaaggtgactgttggcgagtcggcatcaacaagccggaaatagggacaagtggcgtaacaaatgatgttgaagagatcgtacaattatgccaaaaagggggtgtggctacttctggcgactaccgaaacttctacatcaaggatggtaagaaatatgcccatacgatcaatccggcgaacggttatcccgctggacaaaatattcttagcgcgaccatcgtggcggaagattgtatgacagcagacgcttacgctacgactttcatggttttgggagtcgagaaagcgaagctactggcacaatccatcccccaaatagagtatttcattatttatgcggacaacaacggacaacagaaagtcacctactcaaaaggtatgttggaataccttcctaacagaaaaacattggctatcctcgaaaatccttaagttcctacatgaagcgttatctaaatcaacttgaatgcaaaatactgagagccggagattccctgtttaataccacaaccacggataacctattaatcttcgtattttcgggaaaacttattatttacagccaagaagggacacatatagcggaagtggcaaaagatcatttcatgctacttgcgcaaaacaccaatcataaggttatagcctcagcccctacccgccttatcttaatacatgcgggcagtctatccgacatgatcataaatgacccggaatggaatgtggagaaaccggtcgtcttaccgattcccccagccttagcgcacacattaaatcagatagaatattatatgaaggataaatactttaccttgaattgagattaaaaatgtttcaattcctgataaagcttttgcacaggtaatcccatcacgttataaaagctaccattgatagcctctaccccaatataaccgatccactcctgaatgccataccctcccgccttatcataaggtttatatttatccaaataataattaatctcttcatcacccaatttagcgaaacaaaccgcagattcgacggaaaagcctacatttttgtccttcgtcatgatacaaacaccggttattacctgatgtacatgatccgacaaagcatgaagcatagcataagcttcctctcgattcgcaggctttcccataaccccgtcaaacgtccaaacgatcgtatctgccgtgattagcaattcatcatccgccatagtcggtttataggcctccgctttcgaacgggcaatatataaagggatctccatggagtcaatagaatccgggtaagactcgtcaatatccgaaattaccctcacctcgaagtcgatatccagaccagataacaaattccgtcgtctcggagaattagaggctaagacgatcttgtacttttttaaattctctaacataacctattcgattaagcgttacacattcaccaaaattttaccacccaaaagcctcctcgccgaaccagtgtccttgcgcccgcatcgtttgctcgatcacgtccctagctacgccttcgccacctcgccgggaggatatatatttcgctacctccttgatctccggagccgcatccgcaggtgccaccggcaatccgactcgcgtcattacctcataatcaggaatatcatcacccgcatacatgatttgctcaggagacaagcccgttttttccatgaaatccttaaagtcatgcacctttacagcgctacgcatataaatatgctgtatacccaaacgagaaaagcgaatctgtacggcttccgtatatccgcccgtaattatagcgacctcataacctttcttcacggccaattgcaaggcatagccatccttgatattgaccgtacgcatcggatcgccattcgggtgaagcggaatcacatcgcaggatagcaccccgtctacatcaaagacaaaagcctttatttttctcaaatcatagtttatactactcatgtcgagcctccttatgtatacttcggctaatcagctcatatagatttcgcatatccggatctttaagcatagccatatgtttgtttatcacattctcgtcatatcgtatagctggtcccgtttgggcttgcgccggcgacattacatgtaccttagcggctgtctcgtctatcaaaggtaacaagacctctcccggtatttgctgttcttccaagatcttttcagctagcgcatacatatgattcgtaaaattacaagcgaaaaccgccgctaaatgtaagttctttcgcttctcggaggagaggaaacggacatcactggagagcgccctagccacctcgcccagcaccttctcatcttcagacgagttcgcctctaaaaagaacggtattttcttgaaatccacctccctactcttactaaacgtttgtaacggataaaccaccccatatctagccgtaagaccttcaaatacagagattggcatactccctgccgtatgcacccacaaaccgttattcggttttacacgggcgataacatcttggagcacggcatctttcaaagagaaaacatacaagtcggcatcttccacaatctcttccgggacaacagtccacccacatcccaattcatcggctaaaatcttagcatgctcacttgtgtgactatacacttgcccgatactcattccggacttacgcatttccaacgaaagccgggtagctaagtttccggcaccaacaaatacgactctcattctcccgtctctttattttcttccggaagagagaactttcctatatgtatcttctcccattgtaaatgggattcatcaaaaggcttacgaacctgatccttataaccgataccaatgatagacaagacatccaattgataagggatatccagcaacgaacgaacataattattcgaatccgcctcgtcctctgttacccggttccggatctgacaccagcaactgcccaatcccaaatcctctgcttgcaattgcatataaatagaagcgaccgaagcgtcctcgatccaaacatcgctttccatcacattcgccaagacaaccacggccaaggcacaaccctccagaaaagcggaaccatttttcttacacccggcaagtttcttcaacatttccttatcttccacgaccacgaactgccaaggattactacgttttgaggccggagccatcaacgccgctttcaagatcagttctacctgctcgggtgaaagtagttgttcggtaaacttacgtgtacttcttctattttgtataagtgttgcaaaactctccatttttttcgttctttgtactcttttaatattaagattcgcaaatataaatataattttttgcacccatatatacgtatcgttcttttttctcgttagtatttttataattgaacaatagattatgaagattcgtgcgatagccgcgctgctatttatacttatttccgtgagtgcctttggcgagggccgcataaaaatcactggttatgtccgtgacgccgacggtaaccctctggaattagtgaatgtccgggttaagaacacgttgatcggctccatgaccaacgagaagggatattattccttttccatatcgccgggagactctatctccattatttactcctgtctgggatataataaagccgagcgtatcattccctcggcacaagccgacatgcgcctgaacgtacagatgaacaatacctcatttgatttaggggaagtatccgttactgccatccgcaagcagaccacgaccatggagtccttaaatgcggacagaattaaattattgcccgatccctccggaggtagtatagagagcttggtcgttacgtttgccggcgtatcgtccaataacgagctaagttcccagtattccgtacgtggaggtagttatgatgaaaatatcgtttatgtgaatgggatcgaggtattccgtccgcttctgattcgctcgggacaacaagagggccttagttttatcaatccggacctgacggaggcggtcaatttcgccgccggtggcttcgaggctcgttacggagacaagatgagttccgtgctggatattacctataaaaagcctaagatattcgaaggctcggcttccgcgagcttgttgggagcgaatgcttatgtaggcagttctatcggtaaatttacccaagtaacgggtttccgctttaaaagcggtcggtctattttgggtaccatggatacagacgctgaatacgaccctaaatttatcgatctgcaaacttacatcacgtaccaattggcccctaaatgggaaatcaatttcttaggaaacctcgctaacaataattataaattcaccccttatagccgggaaacctctttcggtacagccgagcatcccaagaacttcaaagtctatttcgacggaagggaaagagaccgtttccaaaccttattcggtgcgcttacattgaaacacaaccccaatgagaacacagagttgggacttcaagcctccgctttcaaaagcaaggaagaagagggatacgatatcgccggagaatattggctgagcgagaacggagcggaaaatccggatgacgacgcgtcagctgccatgtccgtaggccgttatcacgagcacgcacgaaaccgtttgaactccaccgtcatgaatgtcgggcattatgggatggcccgccttttaaacaatacgttgaaatggggagccacggtacaaatggagaaaatcaatgataagatcagtgaatgggaaaaaagggattcctcaggttattctttgccccaaaccggtaataacgtaagtgtatattcgaacctcttttctgataatcagatagaaagcacacgcttttccgcttatgcgcaagacgcgttcaaattcaggaccaagcaaggtctgttcacgttagtcgcaggggttagaggtagttattggacttataataaggagttccttttcagtccccgtgcctcattgggctttatcccgaacttcgaccaagacttgacgctccgtttcgccaccggactgtattatcaatcgcccttctacaaggaattacgtagagtagacaaagataagaacggcaataatatcacggtattgaacaaagatctaaagtcacaacgctccatccatttcatattgggaggagattatacgttccgtgccgtagaccggaatttcaaggtgaccgccgagatgtactataaaaagctggacaatctgaatccctacaccgtagataacgtcaagatccgctattacggcgagaactgcgccaaaggttacgccatgggactcgatgtcaaattcttcggagaattcgtaccgggtaccgactcatggatcagcttctccttgatgaaagcccagcaaaccatccgggaaacaacgaccgttcctatggccaatagccaaggctacaacatctcactcttcttccaagattatttcccgggctataaacgagtcaagctaaatctgaaaggagttctatccggaggacttccccagacaatcccgggcaaaggatacgaagccggctatttccgtacgcccgcctacaaacgtgtagatatcggactctcctatcaattggcaggaggcacggacgctatcatggacaggggcttcttccgccatttgaaaaacatttggctaggtctggatgtgtttaacatattagacatcaaaaacgttagttcctactattggataacagatgtatataatgtccaatacgcagttccaaactatctgaccggacgtcaattgaacgttcgtctgattgtcgatttttaataaaatgtatctttaaacacatttactgggagataaaaacaaaaaattatttcctcattcataaaaagtagtgtacatttgcacacaatagaaacaaacatttactaaatctttaaattattattgacatggaacttacacatatcgaacatttaggtatcgcagtgaagagtatcgaggcttgtttaccctattatgaaggcgttcttggattaaaatgctacaatatcgaagtagtagcagaccaaaaagtaaaaaccgcatttttcaaggtaggacagactaagattgaattactagagccgaccagcgaagatagcacgatcgcgaaatttatcgagaaaaaaggtgaaggtatccaccatatcgcattcgcggtacctgatgtacaggcagctttgaacgaggctgaggaaaaaggcgttaaattaatcgataaagctccccgtggtggcgcggaaggcttgaacatcgctttccttcacccgaaatcaacttgcagcgtattgacagaactttgcatgccgggcaacaaataattaatccgttcatttctaacaacaaatcaaaatacaatgagtaaccagcttgaaaaagtaaaagagctcatcgcacttcgtgagcaagctcgcttgggtggaggagagaaaagaatcgaatcacagcacaaaaaaggcaaatataccgctcgtgagcgtatcgccatgttgcttgacgaaggtagtttcgaggaattcgacatgtttgttcaacaccgttgtacaaacttcggtatcgagaaaactaaatatttaggcgatggtatcgtaacaggttatggtacgatcgacggacgtttggtatatatcttcgctcaagatttcaccgtattcggtggagccttgtctgaggctttggctatgaagatctgtaaagtaatggatcaagccatgaagatgggcgctcccgttatcggtttgaacgactccggtggagctcgtatccaagaaggagtaaatgccttggcaggatacgcagagattttccaacgtaacatcttggcttccggtgttgttccccagatttccggtatcttcggcccttgcgccggtggagccgtttattctccggctttgacagacttcaacatcatgacacgtggtaccagctatatgttcttgactggtccgaaagtcgtaaaaaccgtaacaggtgaggatgtaacccaagagcagttgggtggagccagcgtacacaccacgaaatcgggtgtggcccatttcgctgtcgatacagaagaggatggtttgcaattgatccgtaaattgctcagcttcttaccacagaacaacttggaagaaactccgttagttgagtgcaaagacccgatcgatcgtctggatgatgtattgaatgatatcattcccgataacgctaaccaatcttacgatatgtacgaggttatcggtacgatcgtcgataacaacgagttcctagaggtccatgcggactacgctaagaatatcatcgtaggtttcgctcgtttcaacggacaatctgtcggtatcgtagccaaccagccgaaggttatggcaggatgcttggatagcaacgcatctcgtaaagcaggtcgcttcgttcgtttctgcgacgctttcaatattcctttggtaacattggttgacgttccgggattccttccgggtacaggtcaggaatacaacggtgtaatccttcatggcgctaaattgctttacgcttatggtgaggctaccgttcctaaaattaccgttacattgcgtaagtcttacggtggagcttattgcgtgatgagttctaaacatttacgtggtgatatgaattacgcatggccgacagccgagatcgccgttatgggcccgagcggtgccgtagaggttatcttcgccaaggaagtagcagccgctgaagatccgaaagcatgcgcagcagagaaagaagctgaatataagaaagcattcgctaatccttataacgcagctcaatacggttatatcgacgatgttatcgaaccgcgtaacactcgtttccgtattattcgtgctttgcagcaattgcagactaagaagttaagcaatcctgctaagaaacatgataacctgcctctataatccgtaaaacaggagatgaatatgataaataagaaaataggggtattgctactgttaatggttctcttcagtatgggagccaaggcacagttgactacctccgttaaattaaatgaagtgctagttgtcaatgaagataactttgttgatgactatggaaaacgccatccatggtttgagttatttaataactcagcaggtacggtggatttacgaggatgcttcttaacgaacgataaaagtaatcccagaaaatatatgatcccgaagggagatgtacttaccaaagttcctccccgccagcatcttcttttttgggcagatgatcagccaacaaaagggacatttcatgtaaacttcacattcgatccaaacaaagataattatctagccttatatgattcagatggtacaactttgatcgacgaggtgacaatccctgccgggcaaaaagcagatgttagttacggtctggatcttgatggagtaggaaattggagtatccttgacaaagtgactcctagcaccaataatctgacgttagattcgaatgcgaaacttgagaacttccaacggaacgacccatggggtattggtatgaccataacagccatggcagtcgtattccttggcttaatcattttgtatctagtattcaagcagatcggtaacgcagcgatcaaagctagcaagcgtaacgctcaaaaagccgcaggaacaggtgctgccgtatcagccaatatcggtcaagaatcaggtgaaatttttgccgctatcgctaccgctctttatgagatgagcgatgacaaccacgatatcgagaacacggtattgactatccacaaggttcaacgcagctattcaccatggagttctaagctttattctctgcgtcagactccaaataaaaagtaatcatcctaaaatccaattgacgaatgaaaagttttaaatataccattaacggtaacacatataaagtacatatcaactcagttgtagatgatgtggcagaggtagaggtaaacggaaccccttataacgtaaaaatggagaaacctgcgaaaaaacaaatggttacattgaaacgtccggctcaagctccgaccaatgccagcggtgaacctgttatcacccgtcaagcagctccaagtgtagccggcgctgttaaatctccgctgccaggtgtaattttaagtgtagactgtaaagtcggcgatacagttaagagaggccaaaagatcttggtattggaagccatgaagatggaaaacaacatcaatgccgatcgtgacggtaaaattgtagaaattaaagtaaacaaaggcgactctgtattggaaggtgcagatctcgttgtaatcggttaatgatatgcaagaaagtttcttacaattcctaggagaaaatatccaaatatttctctcctatacaggatttgcgaacgcgactccagggcatatcgtgatgctattggtaggtttgctgttcatattcctagcgattaaatatgaattcgagccaatgcttctgatccctattggtttcggtatcttgatcggaaatatccctttcaaggatgccggattacaattaggtatatacgaagagggttctgtattgaacattttataccaaggagtgaaacaaggttggtatccccccttgatattcctcggtatcggtgccatgacagacttctccgctttgatatccaaccctaagttaatgctagtcggagctgccgcccaatttggtattttcggtgcttatatcattgcattgcaaatgggatttgacccaagccaagccggtgctatcggtattatcggaggagctgatggtccaactgcaatcttcttgtcatccaagttagctcctaacttgatgggtgctatcgctgtatccgcatactcatatatggcattggttcctattatccagccaccgtttatgagattgcttacaacgaagaaagaacgtgtgatacgtatgaaacctccaagagccgtttcacagacggagaaaatcgttttcccgatcgttggcttgttattaacagccttcttggtaccgtctggtttgccattgttaggaatgttgttcttcggtaacttgatcaaggaaagtggtgttactcgccgtttggcagagacagcccgcggcccgctgatcgatgttatcacgatcttattaggcatcacggtaggtgcttctacacaagctacccagttcttaacattgaactctatcaagattttcggtttgggtgcgttgtcattcgttatcgctacttgtgccggtgtattgttcgttaagttctttaacctgttcctgaaagaaggcaacaagatcaatccgttgatcggtaactccggtgtatccgccgtacctgacgctgcccgtatttcccagaacgtaggtttggaatacgatccaagtaactacttattgatgcacgctatgggtccgaacgtagcaggtgtaatcggttccgctgtagctgccggtatcttgctaggattccttggttaataaaacaactatctatattaaaaaaggcgaggtccgaaaggatcccgcctttttatgttattgttctcagttagcttgctctataggaaccggactaatctccgtactcgtatcctccaccaacgttgtcccgaggaacaaccagatcatcaaaaggattatagcgacaaccacaccaaataccaatagcgtattcacacttttctttctcatgtctttaactgatttattcattttagaataaacagccggaacatgaatttggttgtgtacccttactcttatttgtttttccctaacgcctcgttcagcactttattcttagcgatcgttgcttggaattctttcaaatagaaaggctcaaaataagccacattctcaaaacggccatcatcatatgcttgctgcgacaaggatgccatatttacagctaatggatagataccatctataaaacaggcgttcggagaagtgattaccgtctcacatttagcggcaccgtctccaaagaaacaaaccttaccgttctctaaaaaagaagcatacgaatcagcatctacgatatcagcagtcgtggcacgtatcgtgttgagatgggaatcataaatcgaagagtagacttccatacgacgggcatccaacatagcgcaatacaagcaatcggcctcctccttatttttccggatagcggcagacgctaaaatatccagcgtatgaataccgatcaaaggaataccatacccaaagcataatcctttagccacagacaccccgatgcgtaaccccgtataagatccgggtccgctacttaccgccacggcatccagttttatccctttcgacttcgcggcttctaatgcctcttccatataaacgcccaataacgccgcatgagacggcccctcgaaggaagccttctcaaagaccacctcctccccttccgacagggctactgaacatacggaagtggatgtctcgatatttaagatcaatgacataataattaactattaacaattgataattgaacgaacaaacaatctcaatccttcaatctgattaggctgcgaaggtatacaaaaattcattatactatcaaggcagccctatgagaaacatctatttatgagaaaataaacatcaaatctaaaaggaaaccactatctttgcgcaaacttttgagaaaaatgatacaatcaatgactggattcggtaaggttactgccgagctcccttcaaaaaaagtaaccgtagagataaaggctttaaacagtaagcaattggatttgtccacccgtatcccttccatatacaaggataaggaaatggagcttcggagcctgttacttcaatctttggagcggggaaaagttgagttcaatatctttatagaatatataggcaaagatactcctacacagatcaatcttgccgccgtagagaattattacaaccaaatcaaggagatcgcagagaaactgaatatcagcgttccgaacgattggttccagaccttgctccgaatgccggacgcaatcaagtccgagaccgtagaaccggacgaatccgaatgggaggtggttttagaaacggtaaaggacgctatcaagcacctgtgtgatttccgtatccaagaaggagccatgcttcaaaagcttttcgagcaaaagatagccaatatcgccactctgttgaaagaagtggagaaatacgagggggaacgtatcgagaagatcaaggctcgtatcatggataacctgcaaaagatagccgagaaggactacgacaagaatcgtttcgagcaggagatgatctattacatcgagaagctggatgtcaacgaggaaaagaaccgtctggacaaccacttgaaatattttatctcaaccatggaatccggtcacggccaaggcaagaagctcggttttatcgctcaggaaatgggacgtgagatcaatacgctcggatcaaagagcaaccacgccgagatgcagaagatcgtggtccagatgaaagacgagttggaacaaatcaaggaacaggtactaaacgtattataataagattaacgagaatggctggcaaattaattatcttctccgcaccctcgggttccggaaaatcaaccattattaattatcttttgaaacaagatttacaccttcgtttctccatctcggctaccagccgggctccgcggggaaccgagaagaatggtgtggaatattatttccttacgccggaagagttccgcagtcgtatcgctaatggagacttcttggaatatgaggaggtgtataccgataaatattacggtacgttaaaaagcgaggtagagcgtatcttgaatgaaggggacaacgtgattttcgatgtggatgtggtaggcggatgcaatatcaagaaattctatggagaccgtgccctgtctgtctttatccaacctccttgcatcgatgacctacggaagcgattggaaggacgggggacagacagcccggaagttatcgaaagccgtatcgccaaggctgagtatgaattagggttcacgggacggtttgataaggttgtcgtaaacgatgatctggagactgcccaaaaagacgcgttgaagatcattcgtgagttcttaaacaaatagtctatgcctaatatattcaagaatacccgttttatgatggggctttctatcgtttgtgggatagcgagcctcgtattaggtggtatcagcctgtattataaggagtatatcatcgggggtgccctgatatttaatatattcatttgttttatcaactataagggttggcaaaagaaggggtaagtataaatcggatgagactcaagaccggcatctacagtggatcgttcaatcccattcacataggccatctcgccttagcgaactggctatgtgagttcgagggactggatgaggtgtggttcgtggtcacgcctcataatccgctgaagaaaaaggatgacttgctagatgactcactacggttggaaatggcccaagccgccattgacggatacccgaaattcaaggtctgcgatattgagttccacctgccgaaaccttcttattccattgataccttgcgagccttatccagcaactatccggatagggacttttattttatcatgggagccgataactggctgctttttccccgatggaaagaatatgaaaaaatactccaaaactacaaactgctgatttatccccgcctaggattcgatatctcgatcccaaccatttatccgaacgtgaaaaaggtagacgctcccttgatggaaatctcctccacatttatccgtaacgcttaccaaaccggcaaggatatccgtttcttcctgccggaaggagtgcggccttatttcgggtcagtagcaaatcagtgacatacctgcgatagaagatatacttacttgggctatgaagtatatatcctatgccacttgaagtatatattcttcgagaagggaagttataccgtgattatttacagctttgccatcttagggcaatctgccaaaattcccattaaaacatgttttacagcacagccgttaaagatgatccccgtaacatcaaaacaggctcactcgataatctttttggagtatccaaatatataatttgagccttgtcaagtgaataactaacggttacaccgaggattactgaatggtttcctcggtgtgatattggcattgttgaacattaagcaaagatatttatgcgaatagacttgacaagatctaagacatacgaggtagcttatccatacgatgggaatgctttggacacttcaaatatattgagggaacactactggacacatagagacattgacttcctaaaaaaacaccaaagaaaaatgaactctttgtatatggtggaaggagtaattggggcagtcggaggagcgatttttgtccaaacgaacaaatacctgcaagcgggtatggaaaatgaggatttctatggctggggcttggaggacggagaaagacattaccgttggttgagttttggctaccggatttatcggagtgagggctgtttattccatttgtctcatccccgggatcaaaacaggatgtaaagataaaattattgggtcttaagttcattggcctacaaacctaagatacttcaccaaggatcctaagatactttatccatgaacaaacaagatcggtgacctcaaccttttaccacataagtcagcataaatcagaaatattttgtacttttgcgccgtattatacaaaataatagcataatgaatctattagaactgagtgaacaggaaataataagacgtaatagcatggagcagttgcgtcagatggggatagagccttatcccgcagctgagtatgtaacgaacgcattttccaaagaaataaaagagacattcaaagacgacgctgagccacgcccggtaagtatcgccggccgtatcatgagccgtcgtatcatgggtaaggcttccttcatggaattacaggattccgaaggcagaatacaggtctatatctcccgtgacgatatttgtccggatgagaataaggacacctacaatgtcgttttcaagaagttactggatatcggtgatttcgtcgggatcaagggattcgttttccgtactcagatgggagaaatttccgttcatgctcaagaattgacagttttgtctaaatcacttcgtccgctaccggtcgttaaatataaggacggtgtcgcttacgacggttttaatgacccggagcttcgctaccgtcaacgttacgtggatttggtagtaaacgatggcgtaaaagatattttcatgaaacgtgcggctatcatcaagaccatgcgtaccgctttggatgaggccggatatacggaggtagagactccgatcctgcaatctatcgccggaggagctagcgcacgtccgttcacgacacatcataactccttggacatcgatttatatttacgtatcgctaccgagttgtatttgaaacgattgatcgtcggtggattcgagggtgtatacgagatcggtaagaatttccgtaacgagggtatggaccgtacgcacaacccggagttcacttgtatggaactttatgtccaatacaaagactataactggatgatgagcttcactgagaagctgttggagcgtatctgtatcgccgtgaacggtacgagcgagagcacgatcgacggtaagacaatcagtttcaaggctcctttccgccgtttgccgatcttggaggcgatcaaggaaaagacgggttacgacttggaaggcaagagcgaggacgagatccgtacgatctgcaaggaattgaagatggagatcgacgatacgatgggtaaaggtaaattgatcgacgagatcttcggggagttctgcgagggtacgtttatccagccgaccttcatcatcgactatccggttgagatgagcccgctgactaagatgcaccgtagcaaaccgggattgaccgaacgcttcgagttgatggtaaacgggaaggaattggcgaacgcttatagcgagctaaacgatccgatcgaccaagaagaacgtttcaaggagcaattacgcttgagcgagaaaggggacgacgaggcgatgttcatcgatcaagatttcttacgcgcccttcaattcggtatgcctcctacgtcgggtatcggtatcggtatcgaccgtctggttatgttgatgaccggacagacaacgatccaagaggtattgcttttcccgcaaatgcgtccggagaaaaccgcaaagaaagataacgccgacaaatacgtagccttgggtatttccgaggagtgggttcccgctttgcagaaagccggctacctaacggttgacacgctgaaagaagcgaacgccaacaaattaagacaagagctttgtgagcttaataaaaaatataagttagaactgcaaaatcctacgatccaagaaatagaagcttggatagccaatgtaggagaataaaagcgtgatacgatggatttgcccggaaaaatcgcgataatgggaggtggtagctgggctaccgccttagccaagatcgtactttcaactcaagatagtatcaactggtacatgcgtaggcccgatcgtatcgaggagttcaagcagttgggacacaacccgtgttacctcaccgccgtgaaattcgacacgaacaagataaacttctattccaatatcaaccaagcgatcaaggactcggataccttgatcttcgctacgccttcccctttcttgaaacaacatttgaagaaggtgaagacctctttgaaagataagtttatcatctcggcgatcaagggtatcgtaccggatgagaatatgttgattacggattacttcgcggagtattacaaggttccgacagaaaatatagcagttatcggtggtccctgtcatgcggaagagatcgctctggagcggctctcgtacattacgttggcttgttccgacatcgagaaggtccgtacgatatcccccgttttcaaaaatcaatacttaaagaattccttctgtaaggatgtgaccggtatcgaatacgccgccgtactgaagaacgtgtacgctatcgccgccggtatttgccatgggatgaaatatggcgataacttccaagccgtatttatctcgaacgctattgaggagatgcgtaatttcgtggacgccgtacacgggctggagcgggatatcaccgactccgtctaccttggcgatttgctggttaccgcttattcccggttcagccgtaaccgtactttcggaaccatgatcggtaaaggatattccgtgaagacagcgcagctggagatggaaatgatcgccgagggatattatggaaccaagtgtatgcgtgagatcaatgagaaatataaagtgaacatgccgatactggacgctgtttatgatatattgtacgagaagaaatcgccgacaacggtcattcgtcaattaacggaaacgtttaaataaaatagcatatgaaaaacatcagtttaaacatcgacaaggctctgggcactgtctccaaggaacaggtttacgctcaagaggccaaggcaatggaatgtattgccacattacataacggtaacggagcaggtaacgactttttgggttggttgcatctcccctcttctatcacggacacagagttggccgacatcgagaatacggcgaacgtgcttcgttctaaatgtgaagtggtcgtagccattggtatcggtggtagctatttgggtaccaaagcggtagtagaagcgttaaacaacagcttcgactggttgcaaaacgaccgcaaaaacccggttatgttatacgccggacacaatatcggagaggattatctttatgaattaagcgaagttttgaaaggtaagcaattcggtattatcaatatctccaagtctggtacgactacagagccggctttggctttccgtatcttgaagaaacaattggaagatgctgttggcaaggaagaggctaaacatcgtatcgtagctatcacggacgctaagagaggagctttgcgtaccttggcggatcaagaaggttacaagactttcatcatccctgataacgtaggtggacgtttctctgttttaactccggtaggtttgcttccgatcgccgtggcaggtatcagcatccgcgacttggttgctggagctgtttccatggaaaaagctacagacgcgagcgttcctttcgctgataatatggccgctatctatgccgctactcgtaacgagttgtataagagcggtaaaaagattgagatcttggctaacttccatccgaaattgcattatatcgcagaatggtggaaacaactttatggagagagcgaaggtaaagacggtaaaggtattttccccgcatctgtagatttgacaaccgatttgcattccatgggtcaatggattcaagacggtgagcgtacgattttcgaaacggttatctccgtggaagctacagatcatagcgtattggttcctacagacgaggctgatttggatggattgaacttcttggcaggcaagcatgtagacgaggtaaacaagatggctgagttaggtactcagttagctcacgtagatggtggcgttcctaatatcaaggtaactatgccggaagtaagtgcgttctatattggtcagttgttctatttcttcgagaaagcttgtggcatcagtggttatatgttgggcgttaacccattcaatcaaccgggtgtcgaggcttataagaagaatatgttcgccctgttgaataagccgggatacgagaaagaaagcgaagctatcaaagcacgtttataatacgatttatcccataaaaaaacggttttctcatcacgaggaaaccgttttttcgtttgaatagttttttattactcatttaattctttaagtaaatcgctcccggccttgaatttgaccgagacacgtggagtaatcattacttcctcccctgttttcggattacgtgccaatcgctcggattgttgccaaggtacaaaagatccaaatcctttcatggaaatagattctccttcccgtattcctttcgccacaacagtcggtaacgcattcactacggttctaacaacatttttcggcaatcctgtttcttccacaagagattgtactaattctcctctattcatactagataataaatataccattcttcaccagaaaagagtccggtgagaactgcgataatttctatgctccgcaagcggatgggggcatccgtataaaggatgagagcctaggcatagattggcggataccgatggacaaggtccttctttcggagaaggacataaaacatccttgtttggaggattttgattcaccgtttgattatcatgtaaatttataccctgaatttgaataagatgaatatattggtgactggtgccaacgggcagttgggaaacgagatgcgtatcatcgctcgggaaagtgacgaccactatgtattcacggatgtgaatcaagtggaaggcgtagagaccggctttttggatattacggatttggaggcggtgaggaagatggtcgcggcgcagcgtgtagatgttatcgtgaattgcgccgcctataccaatgtggatatggctgaaagtaatgaggaattggtggagaagttgaacgctgaggctccggaaaacttagccaaggtaatgaaagagaccaatggttttttagtgcaaatctcgacagactatgtgtttggtaaagaaccgtacaatgtgccttgtcaagagaatcaacaaggaacccccaccggagtttatggtatgagcaaattgcatggtgagcagaagattcaagctatcggttgcaagcatgtgattatccgtacggcttggttgtacagtgagtttggcaagaacttctgtaagacgatgatgaaccttacggctatcaaaccacatcttaaggtcgtgttcgaccaggtgggaacacccacatacgccttggatttggcgaaagccattgagacggtgttgaaagattatgcggataaaaaaaacgaacatgattatgacaagaccggtatctatcattactccaacgagggggtatgctcatggtttgacttcacgaaatcgatcgctgaatacaatggtacgaccgcttgcgatgtgcagccctgtcatagcgacgagtttcccagccctgtaaaacgtccattttattcggtattggataaatctaaaatcaaggagacattcggtattcggatcccttattggacagaatcgctgagacaatgtattgctaacataaaaaacaaataaacagaatcatgtcaaaacgaaatatagtaatcactggtggagcaggcttcattggcagtcatgttgtacgcttgctcgtgaataaatatccggagtataacatcttcaatttggataagttgacctatgctggcaacttggctaacttgaaggatgtcgaggataagcctaactataggttcataaggatggacatctgcgacttcaaggcattctatcaattgatgcaggataagcagatcgatggcatcattcatttggcggccgagagccatgttgatcgttccattaaagatccgttcaccttcgcccaaaccaatgtgatgggcacgctggcgctattgcaggcagctaagctgtattgggagagtctgccggagaggtacgagggtaaacgcttttatcatatctctacggatgaggtgtatggagcgttgaccatgaaccatccggagggcattgagccaccgttcacgacaacagcgtcgtccagtgaacatcatttggcatacggggatgatttcttctatgagacgacaaagtataatccacattcgccctattcagcgagtaaggcaagttcagaccattttgtacgtgcctatcattcttttagtcatttgcaaaggtacgcgtttcttcgatacttgcaacccttccgagctatttttttatcacttattctctttcttatcaataggataggttatccttcacgaaacaagcggttccttcaacaaacctcccgtttcgacgctcaaaaaacgcaagatttagacgatcgtttagactagtcgtttttaaatagcgacgatttgttaaggtcttgaatgatatttaattaacactattattaatattaaattttcgatttatgaacaagaaatttacaacgtttttggctagcgccatgcttgtatctgctttctctgtaggtacggtagcggcgtatgtcggaactccagttgctccgcaagctacaatggctgcggaagaaactccggatcctaatgcgacgataacgcctaaaaaaggggaggccgttttgtttcaaaacggttctgaggcgaagttcttaggtatcacaaaaggaacgaccttcggttatattacaaaggagactgggacttctcagtttacattggagaacttaaacaaggctacttggacagtttcggagaagaagaccgttttaggtcaaacggtttattcttttgtgaacaagaatacaggcttgactttcgctgtagatccttctttggcggcagaggctgttatgcaagaagacggtgaaacggtagatgcggctaaaaccgctaagaaagttaaggatgcggccgtagccactttagggggtagcgctacggagtgggtagtgaaagatcttgacggcagcggcaaaactttggtttcttatgtggatggtaataaatatgtttatctggcgaccagatcgtctgatggcaagatgatcttggttaagggatcaagtacttctttaacgggaacatctgtattatctatcggattgaaccaaggtaatattccgcaggagttagaattaggagcaaaggatttaaataccttgttgcaatcggcagttgaaaactctttccgtttgaatatgactccggaggttacttctggaaagaaaaatcatttgacggcgaccgaccttgttgcggaagacgctactgaaggctatgtacttttacaggctaaagaccagaaaaaagatgatgcgcagttgtatgttgttgttgataccacttattatggcggtacggaaacagatggttccttgcttacttatacgtatgatgcctatgggcctaaaaacgacgatggctctttaaaggatacgaaatctattacgggtaccgtggagggtgaatcagttacatatacaactctaaagaacggacgtttgcaaggctcttataagtataagtttacttataatgcagtagatgacaagctttatgtccaagtgaaggacgctatgcaccaagtgcctcgcagagaggatgagacagatgccgcttatgctaaaagaataaaggacagctttgataatgcgaaatggcaatccgctgaaaacgtagtaaacgacaagtatatttatatggctagtctagccagtgtaaatgtattgtcattgaatacggatgagacggaaaaagaaaaaacaggtgtggtaactcaaaacgtaaagattactatcggtacgagtttcacaggtttgaaaccgactacaatccccgatggtgtttatacggtccagtttaaggctaaggcaggaaatccgaagttcgcccaaaacggtacttatgcgttggctaaccttgctggtgatttcggctgggctgatcaggctaagagacaagatttcaatcatatgccggctgctcaatgggtggttaaaaagaatggagtttctactacgtctgcggtcacgatcaagaaccgagagttcaatgattggggagctgatgcgtctgctgaaagtgttttgcctaagacttcaacccaattctatgcggtggaaggtagcggtgatgtcttttatttcaatggaacaatgcccgatacattgaccttcacgaaggtagcggacgaattagtcaaggatacgaagttgggttataagtacgtaaccgctaacgaggctatggtgcagacctatacatttaattacttgcatggcttgtcattagacaaatatttatacaccccggcaggcaaggactctatcgtacgtgtagacgagaatgatggcaagtccaatttccgtttgatcttgaaagtcaaggatgacaaatatggctatgagaatggcttggtaagaaacgcttactatgtatctgatggcaagggacattatatctcttatgactctgacgctaaaaagtatatgatgaaatccgagcctactttgttcttcttgaaagagaacaattgcgataatggcaagcattactatgcgttagtgaaggctgtggagcgtacgcatgcagttggtgagggctcattcttcacttctgattatttaggtaaagaggttaaggaaggtaagatcgatggtaaggagcttgctaaagtgaaagacgaagaaaatacgcttctttacgacaaggatggctatcgtttaattaaggacaacagcgagatcaagaaggcttatgtgtatacgttgaatgaagatgaaagtaaagtcatatttgacgagattgaattaacttcagttgctgaacaaaaacacaaatcaacggattatgctactgtcaaggtttctgtggatgataacacgttggatttgacggaaggaaagttgaatgataagttcgatgatggcactgacaatgagatccgtacttccgcttttgcggtagaggttgacaactctccattgtatcgtcgtttcgacaacgccgagttggaagagagcgagacagctgacagcttattcttcgtagaaaagatccgtaaggaatacttgatggatgagtggaataagaacttgacagataagaaggttgattacgctggtatctggaataaggagaaagctgatggtaaattggcgttcatcgttgataccgcttgggtaaaccgtggcgctggcaatatcaagcctcaatatttggtgtctgtagctcgtcaggatcaagccggtactccgggtgttccttgtacatatgctcataatcatttcgacaacgccggaaatcctgtagaggcagataaatgctcacatgctactcctgctagccaaggcttcaactacggtaagtatttggtaagtttcggtgactctgcccttattaaaggcaaggaatacaagactccgtatatggatattgacggtggttatactcgcgttggtttcgtaaaggctatccacgcaggcgacagtttgttcatcttggtgaatgatttcgctaacatgaaaccggaagagttgaatgttgagacaattatcaaagcttatgagaaagctaagatcaacgagacatatattgtaaacttgcgaggcgacaaccataagaacgtaacttggtcattccgttacgtaaatccggataaggccgctcaagcttacgaggatggtaaagagggtgagaacaatgagttcatgttcgagtctaacatttattccgagactgctgacgctgctgttacgggtaataaaggtaaggctactgcaggttacaaggaagttaaggccggttccatagctcctcaatatgccgcatggttgaagatgcagaacggttgcttggtattaactcgtggtgattcagagttcagcgcagctaagactggttctgacggtgccttgatcttcaacgcatatcagaagactgacgctgaggatatggtaacatctatcgaaggcgctaacgctgaaggcgtatctatcgtagccggcaacggtactgtaaccgttcaaggcgcagccggtaagtctatcgttatcacgaatatcttaggtaaggttgtcgctgagactgttcttacctccgataacgctacaatcgctgtacctgccggtatcgtagcggtagctgttgacggcgaggaagctgtaaaggcaatcgtgaaataagaaataaacgaaataagataatcatacaattcccgtgcgggtatcgatccaagtaatccgtgacgtattttgcaagttttttacggcaacggatatcgggtacattatattataggatacgcaaaaataccgactgctcacggaaacgatatagccggtacccttgccatcatagcggcaatactgtgccactacgatggcacggccctgccacacggatggcacagcgttgccactgtgatggcacgaccgtgccaaaggcgataaataaactggcactgcaaacaattgataaacaaacatatgctagcatgaaaatttccccagaggagacatctaaaagacaggggactttatcttttatctagatatctaaaaacagaataagaatctgccgttttttttcatatatttgaggtctcatctaaatataaacaaataatgaagcacttgagttcctctattttattggggcttgggttgttttccttcttctcctgtaaagaagcgacagcgcccgcccctatcctgcccgttcccacgccggcacaagttgaatggcataagatggaaacatacgcctttgtccatttcggattaaatacgttcaatgatctggaatggggttacggaaatactcccgcctccacattcaatccaacggatctggattgcgatcaatgggcgcaaacaatcaaagccgccggattgaaaggcgtaatcttaaccaccaagcatcacgacggtttctgtctatggcctaccgccacaaccgaatatagcgtaaagaattctccttggaaagatggcaaaggggatatggtaaaagaactatccgacgcttgtaagaaacacgggctgaaattcggtgtctatctctccccttgggacagaaacagtgagaattacggacaaccgggatatgtagagaaattccatgcccaattacatgaattagtctccaactatggcccgttgttcgaatactggtttgatggggcaaacggtggcaatggctggtatggcggcacgaatgaaacccgtgctatagacgccaagacctattatcaatatgagcgggcacgagacacgatcaaggcgcaccacccggacatcatggttttcggagggacagtacccgatatccgctggatcggtaacgaggaaggttgggccggtgatacccaatggagcatcttcgccccggaaccctccatgcctactttccaacagagtgtatggggagatgagaacggaccgatgtggctaggtggagaatgcgatgtatctatccgtccgggatggttctatcactcccgggaagatcaccaagtcaaatctctggcaaaattagtcgatctttattaccgaagcgtcgggcataacgccaattttctattgaacttccccgtagcgttgaacggaaaaataagtccggtagactccgcccgtgccgtacaatggtatcaaaccatccaaaatgactttaaggagaatctgttgaaaggatgttacgtacaagcgagcaataaaagaggacgtaattttagtcccaataaggcagtagatggggattgggatacctattgggctacggacgatggagtaaccagtggttcattgactttcacgttaacccatcctaccgatgtaaaccgcttggtaatacaagaatatatcccattaggacaacgagtacgctcgttcaatatcgaactcgagcaagggggtaaatggattccggcacagactgtggattctacgacaactgtcggctataaacgaattgtccgtttccagaccgagaaagcggagaagatacgcatcaacttcacggacgcccgcgggccgctttgtatcaataacgtggaggcataccttgcccccgccttggtgaccgagccaacgattgcccgtaatatcaatgacgaggtaaccatacaggccggggataaaggctccgaggttcattataccaccgacggttcagatccgaccaaggactcaccgctttatcaggcgccattcgctttcgctcaaaaaggaactgtcaaggcgattgcctatgatccgactttcgatacagtcagtccggtttccgcgcaaacgttcgatattcctgcttgtgattacacgatcgtatcaccgaaagatgagaaaaccagcctgatcctagacggaaacggctacacaacctactatttgccacaagggaaacaagagttagtcgtacaattagcgaaagaaatgcctatatccggattccgctacaccccgaaccaaggacgtgacgcaagcggtcatatctccaactatcaattatatattaatggaaagaaggtggccgaaggcgaattctccaatatcaaggctaacccgatcgagcaagtcgtacatttcccgataacgaaaggtaaccaaatccgtttggtcgcaacccgtatcgtagataataaaaagcaagcgggtatcggtgaattctcggtaattacggaaaaataaagaatatctaataaaagcagaagggaccgcctcgaaagtttaatttccagaggcggccccttttaattatttatcaatcttttatttatccttgaaggtaccggttcatttgcttatacacggcacgtatatttaatggtttagatatatgagcgttcataccagcctccctacttttctgcacatcctcagcgaaggcgttggctgtcatagcgaagataggaaccttttgagcatcagaacgccctaatgcacgaatacatcgggtagcctcatagccatccatatgaggcatctgcacatccatcaatatcaaatcataatatccttcggcagactccttaaacatctctacggcctgtaccccgtcctcagcactctccaccgacgcaccggtaactccgatcaattcctccgctatctcccggttaagctcattgtcctcaaccaataagatccgtttacctttgaagtcataatcaacagcataacaatccttcgcaaggtcattcctcccattaatatcggaaaaacgagtgggcttacccgattcctttattttgccgaaaggcagatcaacggtgaatgtactgccactcccctgcacgctcgtcacatgtatgccaccacccatcaaccctgtgaaacgcttaacgatagaaagccctaatcctgtacctccatatttataagtaacatccacattttcctgttcgaacgattcgaagattttatcatagttctcctcggctataccacatcccgtatcgattacctcgaaacgtaggtaaacattctcttgatcctcacctgttttagatacccgaagtttaatcattcccttggccggcgtaaatttcagcgcattcgataacaggttggagagaacttgattcaagcgcaaggagtctcctataatctgtacttccagatcactagccaatatcgtctcatagctgatccctttactcttggcctgctcgccatacagattttcaaagtcctgcaagaatgcccggaaattaaagctctcatgtcgaagttccacttttccgctttctatcttcgacatatccagcacgtcgttaatgagagcgagaagatgcttggaagacatgattactttctcaagacagtcctttatcttatcggtattatctatgttttgcatggcgatagtactcatacctacaattccgttcatcggcgtacggatctcatgactcatccgggaaagaaactcgctcttcgccaagttagccgcctcagcccgtttcaggttgccctgtatcacggtcgctttcatccgggcccctatagccagcagtaatgccgtaaatagcaccgacaggacaaacatcacgataaacatgaattgtaagggattcgcatatataaagtccgtaagagagaattcattcacgccgatagattccagattccgattgcgtataacagtcctctcggactcagaaagattattgatcgccttgttgagtacggttaataaatccgggtcaaccggggtaggtaacgcaaaacttatcgcactctgatcattgaccaatgtcacaggagcaagattggtgaaatgataacgcgaaatatcctgttccattttagaggacaatccatagataaaatcagcctctccgctattgacagcggctaatgcctccttaatgcccggataggaccgaatcttctccgcagatatgccacttggaaatcgctgactttccaccaaagcaccaaccaaacccggagcgggataactacaggctttattgcgtactatgatattgttcgcactcacataagaggctgaaagcgcaagccctagctgggccgcatcgttctcatctcccaagaaaaagcctaagatatcagctttccctcgttgtaccagatggaccgcatcactataattcttcgcatacacatacgaaaaatccaaacccgtaaagtccttgatctcatccaatacatccaccatgataccgacatggttcttctgggaggtttctttacaataaaaaggataccaattctccggaacggctaccgtgatcgttttccttttcttgacatattccagatcccggtcactaaattggatatttacaagtcgggcaggaaagttagcggcataacgctctgccgcgaaatttggattggcatccaagatccgttccaaagccatattcaaaccatccaatacttccttattacccggattggttacgatataatagggttgagaattatatgtagcgatcacccgtacagaatcgtgattgtaaataatgccactcaacagcaagtctatctctccattcattaaataaaaatataatccctcgtcgttcttctgcatatctttcaagctgtaatattggaacttacagtctaatccgttgatagccaaaaactccttgaggcggcgaatattttctttcgcattctcatatacaccgatggttttcccgttcatactctccaaattatagctatggatagtacgatcgtcagaacgagcaagcaacaaagaacggctatatcccatattgtaatccggataagcataatatttctctaaaccgggtatataatagtttccacccatcaattcatactgacctgcgataaattcattcaacacggtttgcctattcgtatcaatgtactcgtattcccaaccggtatatttggcaatctcattgagatagtccacgagcataccatgatgactaccgtcctccgccgtccaactcatgcctaccacctgcggaaaggcaacccggagcacacgtttttcacttgtccgtgctaacgtagacaaatgaaacgccagcattataaatactaacaaacttatagttataccatgacccacatatctcagaagtaagttcattataatgtatatcttttattatcggctttcccgatgataacaacccctagacctctccgcaaaacaacggtttatttaggataatgcctattcattcttgtgaacaaagcttttgcgtaccccaaaacagagtacgcaaatatactacattttatatcacagcggattataaaataattgatttttaagagaagatactataaaaacagaagggaccgcctcgaaggtaaaacacctcgaggcagtccctttcctaaatcccaacaaacttttatcccatcgaactattgattacctgtgtggttttctcaaaactcttccttaagacctcctttacatccatggtttcccaatatcccttattaaaaagctctacggataacccaccccggaaaccggagtcgtatagcaaaggaagtaccttattaaacgggcaaataccatctcccggaaacacccgatccgaatctctcaactccgtacgaggaggcaactccggataatcgttgatatgaaaaaccggaaggatcttcccatttatcaagcgtaaactatcaaaactatttcctcctctgtacaaatggtagaaatccaataagacagaagcccgcgaatgcccggaggcgatcgctatcgccatggtatccgataattgattcagaaccccggctccccatagttccaatatcggagtgacacccatctcatcccctaaatccagtatcgcccgatagcgttcggaatactctggcaaccgtgtacgatccagttgagtaactccttgagcaggagcggcgataaatttaccgcccaatcccgctaccatctccatatcatgccgcatttggtttagcccttccttccgtttcgaaggatcatcggcaaaccacgaggcaaaaccgatcatattctccaataaaagtccggaaccttccagctgacgcctgagtgtctcataagttcccccttgctttacgaacgcatccacatcacgggtccataactcaattccctcaaaaccagcctcggcacataagtcaatctgtttttgaacaggaagtttataacccgctatcgtagagacattgagacagacacggaaaggacgtttcgaagaggatgcttcgggtgatggctcctcttttttcttcggagcgcaagaagccaagcctgcgaacgtactgcccaaaaccgccagaccggtagtccgaagcatattacgtcttgaaatctttttctcaagcataacactctcgttttaaattaaacctccaaagatttacgggcctcccggtccggatcattccgagcctcacacgtattattcaagatcatcacctctccattttcttccgtgtatttcggccaaacaggtaactctcctccgttcggatctcctgtccgcataaaattcaacaaagcgccagacatcttatctgacaacgcacgaggtaccttacctccacccgtatgggtaaacatccgatccgtatttttaaaccagaaacagatatccgagcaatggaacgcacgcatacggttattaaacaagggcggacaccagccaaaccaagcgacatacacaggctggccttgctttaattttgcgttagccgcctcaaccactcgttgacgggaagacaaaatcatcgcccaaagctccatcggagtcttatccgggaaattcttggcgaaagccttcacgatcgattccgctttatcaccatattgacttctcagtttctcgatcacaccgtcttgagtgattttttccaaggccgcatccgccctgttcgggttccattcatggaaagtcgtacagaatatcatcgggacgacaggagactccaaatggctctcaccggagtagaatacaccggccggaatattccggtcatcagcaacagggccaaaagtccgtctcatgctaatcccttgatcttcccagcactttttacaagccctatccgctatatccaaatattcccgccaaggtattctttgcaatttatccagttgggaagcggtcagccccgcttctctcaaaatatattctcccaccttccgggtcatcacctgatcggaagctcctaccgtagatccacttaaagccacggctctatggatcaaacctttcgccgccggcatagcggctaccgtacagaccttagaacctcctccggattgtcccataaccgttacgttcccgggatctccaccgaaattggcgatattatcatgtacccatcgcaaggcggcaataatatctaacatccccacgtttccggaatccttatacgcttctccaccaacaccagataagtcagagaagccaatcggccccaaccgatgattaatggaacagaatacgatatctccttcccggcttatattctctccatgatatccatcctgctcgatcccactaccatttgtaaaaccgccgccatgcagccacaccaatacgggacgtttcttaccatccgcaatgcccggtgtccatacatttaaatataagcaatcctcactcacatcccagtagttccaatgatcggcaaaagttccgtaattattgggccaccggttctccatacgttgcggcgccgtattcccataaaaaaccgccggtctcacatctgtccacggctctggcttttggggaggcatgaagcgattttttcccgacgtatcagccccataaggaactcccaagaacgtatatacatgattcagcagatatccctgcaccttcccatactctgtctgggcgatggcgatatcgtcaccgataaataggaattgatcgtcatcactcactttccctcttttatcacgggaatccccagaaggggcacaagaagaagtcgatatcaaacttcccatactcaacgaggctgtgcccaatcctaagtttcttacgaattgtcgtctgtttattttcataatctcttaattcatctcaacgaccaatacctctttagatgccagcttcaagctgtccttaaataagatcgttcgtttcgttattatatcctttccttctattccctcttttaaagattccttataacgggcaagtggaagatcaacttcatgattagctccattaataatgaccatgacacttttaccctctagataacgctcatatacatacactcctaattgtggcatataatgtttcatattaccttcggaaatgatcttattgcccttcctccacttcaataaagtctgtaaataatcccaagccttattctgtaggtcggaacgtccttccctcgtaaaccaattctgagaatctccaggccaccctcctggaacatctaaacgtatattcccatccccacccgggcgacttttcgtcccagacattaacaattcatgtccataatataattgaggagtgccagggattgttaataaaaaggcaaccccttgtttataaccatctaagtctttaggctccgaacgtaaaaacctatcagtatcgtgattatctaaaaaacgcaaaacatttttaatatctggatacacgaaatcataacacaaatgatcatagattttatctaatcgcccttccggtgaagacttgtcattaaagatatcacttgcaatactcatcagagtaaaatccatcacagacttcagttccgtatcttttccaaaattaagtttacaccctttttgccaccaagccgtaccaatcgtataattagtccaaatctcaccaactatattaaactgaggatattcattcatgatttggatattccactcacgcatcatatcaaaatcggaatatggatatgtatcttgcctaatcgcatcaatccgagcatactctatccaccatatagaattctgaataagatatttaccaacatgaggatttgcttgattcaaatctattccaaatcctgcatatttcattacttcagaatcataagttgatgcataattgtcatagaaaatagccttagcatgattcccccttttagaaggacttacattaaaccaatccttagatggcacatctagcacccaaggatgatttgctccaatatgattaaaaatcatatccataacaacccgtaatcccttttgatgcgctttatttatcaatcgaaggtaatcttcatttgatcctagacgcctatccacatgaaacatatccgttgagaaatagccatgataagaacctcctttcccatcattctccaacacgggatttaaccatatagctgttaccccaaggtccacaaaataatccaaatgatcttcgatccccttcaaatcacctccatgtcgagccccaggcttactacgatccatcacatattccgttgacatagaaatctgatcattcgattggtcaccattagcaaaacggtccggcataattaaatacaacacatccgaagaatcatatccttgtatatcatctgtactctccttgcgctctttcagctcgtaagcatatacgaacttcttttccccattcacaaaagttatatcaaatgttccagaatgagcttgtgataaatctaaatataatattaaataattgggactatctaccgttacacaactttttaaataaacaccaggttcatttataacaggatgatattcagaaatatgatccccatataccatcaactgtaattctggatttctcattcctgcccaccaaaacaacggctctaccttatttatcgtttgagcagccactgtcccaagtacaaataacagaaatgaagtaaatattattatttttctaatcatagctataatcatttagatgtaaaagcaaataaagggtgagccaaactcaccctttttaaacagccaagttaattcatattaacatcaggattaccattctgctcaacatccggaatctgaaacatcactttatgagaatcccaagcttcaccacgaaccgactgtttgatacgcttcaattcaaataatctctcaccttgtaaagctatttccaaacgacgttccttctgtactgctttaataaaagaagccctatccgtagttgtagtattagctttgccataagcccttttttctattttttgcaaagcattcaaagcttgattcatatttccattcgattcagctaaagactcggcataaagtagtaacaactcattatatccaataataataccatccatatactcataatcaaacttcagagtataccatgaaccgtctatatttttaaaaaacgttttaaaacgattatcattttgttggtcataagcagcaatcaactcattagacggcctgcttgtgggtaaagccaatccattcgtacgataatctcttaaaccaccccaagaatcctcaatcaatgacgcagaaggtatcatcgctacaatttcttgcgtaacagtctttttttccgctctaccgaatttagcagtcaaatcctcatcaagatcatacttctgagtattaataacttgttccgcatatttagccgcattgccaaaatcatgtttataaaaatacacttttgccaataacgcttttgcgccatcaacagtcgctctaccagactctactttgttctctccaggtaaattcccgatcgcatattccaaatctgagattatttgagaataaacttcagagaccgttgaacgttgtacgacctcaaatgcggtagcacgatccatcaccccccttaaacgaaggggaactcccatctctgcgatatccttagtctcctctgcataaggaagaccaaaggctcttactaaatgaaaatatcctaatgcacgaataaaagatgcctcagccttaaattgagcttctttctgaggatcactcgccaagatactttcccctaaatcgctaaacgcaacttgattcgccatatttatggcattatatgtcgcggtccaggtatcacgtccaaccgcatttaccaaattcattgtatgagcactcatctgaacccattcaaaagtagccacatctgccacaccatcatctgcgatcacatcaaaaccacgcaacgtccggcctccccaaaagcccgaagaacgtattccattataagcacccaacaataaattctccaaatcatctaccgtcttaatacgatcatctgtcagttctaaactatctggttttatttgtagaaatcccatgtcatcacatgccgtatagactaattgggtactgagtaatattgctgctatatattttactttcataatcttattcatttaaaagttaacacttaatccgatagtatatgtacgagcttgaggaggtgttaaataagtcacattcaaactcaaattcctcttctgagctgaatcgacatcacgcataatctcaggctcaccactatatttattatagtattcactaaataaagtcaataaattagttgcttgagcatataatcgaatatcccttatattaaacttcttgattctaatacctttgaaagtataacccacatttacattttttaaacgtaagaatcctgcatcatgtagatattcagttgtatttctcgccagttcaatgccactttttcctaaacttacccgaggtacatctgtcacatcaccaggtttctgccatctatcaagaacattacttttcagattccaagtgccaacattattcatctgaaatttctcaccatcgtcataaatattgccgcctatttggaatgtaaacataaaaccgaaatcccagttcttatatgtaaacgtattattcaaacctcctacaaaatcggaataaggatggcctacaggctgacgatctctatccgcattatattctttagtttcaccaaccggtttcttattctcatcaagcatttcataaacaggcataccatcctgaggatcaacacgtagaaccttaaccaaatagtttacgccaataggctgtcctactaacacacgtgtatcaccttctccacttaatgcgtctggtcctgcattaccaacatccaaaaccttattcttattatagctgatattaaaatcagtagtccatgtaaaatctctatttgtaatattcacggatttaatattaaactccacacccgtatttctgacttttccgatatttgccaagaatgccgtatatcccacagatgctggaacacttacattcaaaaatagatctttggaattcttattataaaatccgatttcacctgaaatccgattttttaagaaaccatactccaaacctacatcaaaagtagaggttgtttcccacttcaaatctgggtttttcaaagaattgatataccaataattatcccctacatacaattgattcgtattcacgctaactgccccccattgcgcatagttagggatttccgcattaccagtaataccaaaacctgttttcaatttcaacaagcttacaacctcgttatcttttaaaaagtcctcttccgtgatcatccaaccaatagaagccgcagggaaattaccaaatttattattctccccaaatcgtgacgaaccatctctacggaaagtaccagtgaacatataacggtctttaaatgtataatttatacgtccgaaaaaggatataaatgagaaatcttgattaggatagctcgtaaaagtcttattcgtttcatcataagccggattattaaataaccaatcttcttttccttgctcaaatacgacattcgtataattcgatactcgtgtagatttcaatgcttctgttcccaacaagaaatgaaaacgatgtttttcattaatcgacaagctataattcaagagtgctttcgcattccaatttgtctcataacgatttgtcacattactattcggttttgttgataattctttcgttcgtaaataattagactcattatctcgataatctatattaccttctagccgcaatgacaatcctttgattatctgtaagtcagcatataaacttgccattgtacgttgggtaaatattctacgtcttttctcatttgcctccgtcaccggatttgttgatttaggaaaaacataataactaccatccgaattataggctgggaaataaggcaaagccgtacttatggcacgtccccaaccaccatcccaacttgaaggagtgggtcgatgatccgtgtgagagaaactaaaatttccacctatttttaaaatgtttataggcttataatcaatattaaggcgtacgctcgtccttccgaaatgatcattcaccaaatatgaattctcttctacattagaaacccctaaataagtctgtattttcttattaccccacgataccgataaatcattgtaggtagaaattcctgttctcgtaataagatcttgccaatccgtattatttaataaagcttgttcttctgaataaccaccgggatatgatgatacagtagaaggatctgtcgcaccagagggattaaacttataatcattttccaatgcttctttataaatatccagataatctttagtttccaacatatcaactttcctattagttgttgaaaatgcaactttagaactaaaatttatttgaggttttcctgatttaccacgtttagttgttattaagacaacaccgttcgcacctctggatccataaatagccgttgccgaggcatctttcaatatatcaatactttcaatatcattcgcatttatagatgacattggattatcttgtgctgcacccactcgatctccggcattttgcatgataggtattccatcaacaacaatcaatggatcacctccagcggtaatagaagcgatacctctcactcgaatggctgcaccagagccagccaaacccgatgtttgggttacttgtacaccagcggcacgcccttgtaaagcggcatcgaaagagcttgttggaacagacattagttcctcacttccaactttagcgatcgatcctgtcacatctctcttattctgaactccatagccaacaacgaccacttcatctaatgtctccacatcttccgatagacgaacattaatatgagtctgatttccgacctttatctcttgggaacgataaccaatataagaatacactaaaatggcatctctattaggtacctcaattgaataatttccatccatatcggaagtagtacccgcagtggtacctttaacctgtatggtgataaaagataaaggctctcctgtctccgcatcagaagcagttcctgtgatcttgatttgcgcaaacgctgtcaatgaaaacaaagaaagcataaagcacataataaattcactaatacttttacatctcatgacatattaaatttaaagttagacaagttctaaaatataaacaccacgagccggaatatgaaccgccgtgtctatcgcaacgatcgtatctgttataatatctttcccagatctataatcttttacgacttcatgaaaacgattcatatctaatgtctggttttgatctgttccattcattaaaacaagtaccgttttattatcctttaccctagcatatacgtaacaacccgatttatcaggagtataatgaatcaacttaccttctttaacagcatcacatcgctgtctccaattcaataattttctcatataatcccaagcttgattctgcaaatccgtacgtccctcaggagtgaaagcatcttttggatctcctgcccaacctccgggaaaatcagtgcggataataccatctccttctgcttttgtcccagacattaaaatctctgtcccataataaatctgaggaatccctcgagttgttaataaaaaagcaatagcctgtttataccttcttaaatcagattctcctttctgcataaagcgtcctaaatcatgattatccaaaaagactagtacattattaggatccgggaataaaaaatcctgtgcgataacttcataaattttaaataaccctgcttcgaatccttcacggctagaacatgcatctccaaacgctttttggcaagtaaaggtcaaatcaaaatccatcactgtctttaagttactattagattcattcattttagaatctctttgccaccaagccgaagcagtccctcttggataccaagcttctcccacaatattgaaatccggatattcattttccacctccttacaccaagttgccataaaatcataatctgcatatggatgtgtatcttgacggataccatcaatccgtgagtattcaatccaccaaatgctattttgaatcaaatatcgggctaagtgcctatttttctgatttaaatctggcatacctctaccaaaccaaccatttaccaagatctctctctccgactgaggagcgtgaacatccataagagtccatttaaaatgatttgtttgaacaaagttgtcttgattattcagccaatccgaggaaggaaaatcttttaaccaccaatgagagcttccgcaatgattaaaaatcatatccatcacgactttcattcctttttcgtgggccttatctatcaattcacaatattcttcattcgttccaaaacgaggatctacctgataaaaatcagtaatagcgtatccgtgataagaacctcccggcatcctattttccaatacaggatttaaccaaattgtcgtaaagcctaaatcacggatataatccaatttattaataataccacgtaaatcacctccatggcgagctccccctctcgaacgatctattttcacatcatctagattgtcattagatggatccgcatttgcaaaacgatctggagtaatcaagtacatcacatccgcaggtgaaaatccagcagctccaacctttttatttctttcctttaactcaaaggcccggatttctttctctttccctttttgaaatatcaaattcattgtaccgggagaggcatctctggagatatccaaataaaggaacaagtaattagggttctcgactccaacaatttccttgactcttacccccggataatcaatataaacttgagagcttgcgatattcttgccatataccataatctgtaattccggatttttcatccctacccaccagcaagcaggttctaaccgtgaaatatcaatagcatatacagaactggcgcacaacaagcaaatggtaaacaataatagtcttttcataatttcattcattttatattcggaaattgccaagggcttctatatgttttgttcaagtatgcatctgctttaggattgtccacaaatttccttgtttgaggatcgtataccacacgagttcctgtccgatacgagatattggccatatgagccaatattgtagcaaaagcccccttttctatcggactatttgtctcaatcgatttattcaaaatacatttacaccaattcgtcgcatgagcctctactcccccatcttcaaatttaccaaccaattgggctctatcggccaaaaggataccatcacgggttttctccggtatcaactcatagccttcacgattacataccagagtggctttacttccgacccaagcgaccccttgattccgattataaaggtaagcaacttgttgagcccattcaatatggaaattcttatattggaaaatacttgtttggcaacttggagtttcattaaacgatgccggatctttatatgcagtagaaaagaccgcgtcagggtattccctatcacataggcctaatgcttttaatccgtcaaaagcagaatcaatccaatgcaccccccaatcagtctgttggccaccaccataatcccaaaaaccacgccaaccacgaaaacgggaattattaaaaggacgttccggagccggtcctaaccacatatcatagtccaaagtggatggtgcctctgaatcctcaacagaaggacgaggatttgtagattggcaaagccataattgtaccttataaacatcccctagcacaccagattttaatatttcattcgcagccctgaaatagcgttggcttgtttgccataatcccgttgtcacaacacctttatactttttctgaaagtccatcatcgcattgcactcagaaattgaattaccaacaggtttctctacataaatagcttttcccgccttcaaggcttctgcaaaaatataaggatgccaatggtcgggcgtggcaataataaccccatcaatttctttattggccagtacctcccgaaaatcagtataagcttttatagaaaccgtctgttctggaaaatctttcttaaaacgtgcaagctgctcttcaagtctgactttattcacatcacacataccgacacaatgtacccatggattatcagtcaacgctccttgcaaatctcgacatcccattccaactccaatcacggcaattcttacttttccatttatgacctcttctttctgataagatcgtaagggtgacgaagacaaaagaggagatactcctaaacctgccgccagcattgttgtatttttcaagaaatttctacgtgtagtcataagttatcattctttaaggttaaacttctttctacaaatctctaatccaaatatttcggaaagcaacttctaccccatggtcttgtaaacttaaaggcatacggccatgagctacatatttaggtaaccctgtatatggggtattccctttcagcacataattattctgaacaacaatcccattcaggacgactgttatcatcgcaggagattccaactcatcatttgttccaaaacgaggagctttccaatatatatcataaacttgccattcattcgtctttgtaaaagcatttgctaaaggagcactttgcttataaacactaccaacccagccatttacgtaagtaggattatcctcacaatctaggacttgtacctcataacgactttgtagcataatgccactatttcctttcatttgtaaagtattatctttacctggtatcggggtcttaaactctatgtgtaattggcaatcaccaaaatactcttttgtacggatagagccagaaccgggaactacaaccatcgtcccatcctttatagcccattttgcagatccaccatccttcccagcagcttcccattttgtaagatcttttccatcaaacaggatgattgcatcagaaggagcacttgttccaactccaggggttacttttggaggtacaggatgataccattctgtactttccggtttccaccgctcttgctgcctttgttgttgattaccttgttgagcacttacaaagaacgctccacataaaaaactgattaaaacaattactttcttcatattaacatagtattaatttaacgttactagtcttatctcattaaagaacttgtcgcaaatgtatcattgatattgaaaaataaaccattcaatcatatcaaaattgttacttttcgtatcaacacacctataaaccaactagaattagaagaaattggaatctgaaaatcaatattgagactatatgaaaaagaatgaaactaatttacaaaagcaaaaatcaaaaaagttgatatcttgcaaacgaaacatggaaaacatcaacaactcatgaaatttcaaattgtgctattatgcttattcttcttagtagaactgaatgcaaccccattctactttaagtcctatgacatggaagacggattaagtaataatcatgtcacatgttgcgtacaagacgactatggctttatgtggtttggtaccagagatgggctcaatagatttgacagcaaaaaattctatacattcaagagctactcttcagaaaaaggctctttaatgagcagttatattcttgacttagcgaaaagtcccaccggacaaatttgggtaagtaccaaccttgggctacaaaaatatgactatcaaacagattccttcacactcattgatttcaccaaaggaatcaactgttattcactacaatttgaccagcaaggaaatctctggatgattcttaatgggtactcactcgtaaaatacaatgaaagtcaaggtatgcatcttaattatatgtataaaggaagtgatcctattacctccttttatataactcctcaagaccaaatttgggcaacaacagcgaatggtaatgtcgtttttctagatgatgacaaaaatgaattcatagccttagatatcaagaatctagataaaaatcatcctatcgatgatatgacagcaatatgggcctctcctttagataatatattattaattggaactaaagataatggtataaaacgaatcgatatacagacaaaaacatataaagatattttacctcaacaaaaaaaatctccactttatactagaaatatcattcgtatgacaaaggagaaagtatggattggcacttttaatggcatatatttatatgatattcaaaatgatacgataatgtctatccagcaaaataaaagtgacctctattcattatccagcaatgctatcaaagaactctacaaagatcaagaaggaggtatctgggtttgtactgataatggcggtatcagctactctcctccttattcaaaattcaaaaggcactataatattcctggacaaagaacgctcaatggagatattatacacgatatttgcatagacaaaaataataatctatggattggcacagaagacgctggattgaataagctaaacatgaaggaccattcatatacatcttttaatgacatgaaaggcctttcacaaaattgtatacatggattagcgtctatagataattacctatggatagggacacacgctaatggtattgatttaatggatatccgtactgagaaaataatcaaacattacacgatttccgtaaatccttatgcaaacaaaaacgacatcatcgtatacctttataaactccaaaacaatgatttgctggtagctaccgctcttggtgtctatcaatataattctcaaaaagacatttttgagcaattaagccaatttcctaataattgtaggatacaaactctttttgaagatcatgatggagtaatatgggctggaacatcgaataaaggactatattattataatcctactacttcccaacacggagaatttaaattagatacagtaaatacaagccgaacaataaacaatatttatgaagatcgtaaaaacaacttatggttcgcaactggtgacggaatcaaaatttatgaccgtagtactcaacaaacgaccaaatacgatatgcaagatggcttacctagcaatgtaatttaccgtattgaagaagataaaaaaggaaacatgtggatcagtacggctaacggcctcgcaagactcaaccctaaaaaccataaaataaaagtcttcaaaaaagaacatggattaacttcaaatcaattcaattataactcttctttaaaaacagataatgacaaattatattttgggacactaaaggggatgattagcttccaacctaatagtatccaagaattttccattcaaccgaaagtatatatatcacagattaattataatgatccagatcataacttcttacaccaagaggctatcacttttaaaaaagggatcaccttagaacataatcagtccacattctacatcgactacacatcattaagctaccaagcccccaacctcacccaatacgtctattgcatggaagggttaagttccaaatggtatcatgtggtgggcgagaaccgggtttatttcacgaaactaccgcccggtaattatacgtttaaggtgaaggcggcgaacctgtccggtatttggaatgatgagccggcgatgttccagattacgatccttcccccatggtggctctctaccaaggcgttaatcctatatgggattatcgctatcggatgcgtagtgttgctgatctttatcatttcccggcataataaggccaatatacagcagaaaatacaggagttcgagaatgaaaaggagaaggagctttatcaagctaagattgatttcttcatcaatatcgctcatgagatacgtacgcccctaactttaattaaaagtcctctggagaaagtaacacgggacatcaagctatctcccagcgcaaagaattatctgacgattgtggataaaaatgcgaaccggctactggatctggtgaatcaactactggatttcaggaagacggaaatcgaaggatataaactaaacttcatacatacggacatcatcgcattgatgcaagagacctttgagcgtttccacgacacggcggagcaggaggcattgcaaatgattatcgagtgtaacgtgaaatctttctacgcctttatcgataaggaggcttgcacgaagatactcagcaacctcctatcgaacgctattaaatacgcaagaagcaagatcatcgtccggttcgagacgcaagatggcgagcgattcacgatcgatatcatgaacgatggaaagcccatctcggaggagataaaagaaaagatcttcgagcctttctaccgggatgactcctctatccataaatccgggaccgggctcggactacccttggcccgttctttagcggagatgcacgagggatcgttgacgttggaggaatctccgaccgggcttatcatctttagattacgtttgccggtgaaccaaccgaactcattaaaactagaggaagagaaagcagaggtcctgaccaaccctgccagcgagcggaaatatgtcacccaagaatcccgcccgacggttctcgtggtggaagataacaccgaaatgctccatttcatcggtcaagagatcaatgtccattacaatgttgtcaccgccggtaatggcgaggaggcgattgcccgtcttcaggaatatggcatccaattaatcatcagcgatatcatgatgcctgtcatggatggtttcaccttattgaaaaagataaagactaatctggagttctgccatatcccgatcatcctcctgacggctaagaacaccttgcaatctcgcatggaagggcttgagctgggggcggacgcttacatcgacaaacctttctccatggatctattgcttacccaagtgacgaacctgctgaacaaccggagcaatatgcgtgcctattatttcaactcgccgattgccaatatcaaatccatggcttacacgaaagcggacgagaagttcttgaagaaactgaacgatatcatcgacagccatataaacgacgtgaacctagacgtggacatgatagcggacttgatgaatctaagccgtccgaccctttaccgtaaaatcaacggcctatcgaacgtaacgcccaacgagttgatcaagatcagccggctaaagaaagccgccgagttgatccttcaaggcgatatgagaatttacgagatcgccgaggcggttggtttcaactcgcaatcctatttcagccgggccttctccaagcaattcaacatgagcccctcgcaatacgcgaaagaaaataatatcgaattgaaatagcccgctaggaagaataggtctggaaccagcgggttaccttctcgctatacgtcttggagatcgggatatcgggtactttctcgatccccagctctagataaacgccctccttctccctgcggatcaccttcacttggtcgaaatttaccatgaaagaacgatggcaacggagtacattcgtatcagcgaggctctcttcgatcgccttcaaggagttgcgaagcataaacttcgtgagctgccccttattcagataccagatacaaacgtaattatccgccgattcaaggtacagcaggttacttcgcttcacggaaaggcgcaactcgttcttctcgtcatagaaagagaaaacgctttgccgaaccgccgcttccgtctggttctcctccaacaatcgcaattgtcgctctttctctttataagagaaatacaggtgcagcacggaataagggagcaataaaaccagactggtattcaccgccgaatcgttaaaaacttccatatattctcgttccggattcagtaccaacgtataaatcgtatagaaaagcgacatgaagaatatctccagcacgatccagatcgcataggtccggaccgtgatagcatgccgcttcccccaatggaacagaataatacggctcaagacaaccaccaatactcccgtcaagataatcaagctggagaatacgaagaacttaaactccgagaccttgtaccaagaggtggagctaaacggcttgtagatgttgataaacaccaacgcaaacaaggccgtccacaaaatcagcctcacgatattctgtttaccgtatatgtaacttggtattttttgatcccacattcccatctttttgcctctattttggaacaaatgtaatcattttcccagacgaaattcacccctctataaaagatttcacccctaaataacactttatgtccccaacaaagcccgtttaaaccatttattttgaagagatgtttttctattgtttgtttgcagtaaaaaatcagaggattatggatatttcacttcgtactaagcaactgaacagtcttttctcttatgacaaaaagactgaattggaagagagccatctggagatcatcccgtttcgcttcacccagacccgtggcgccagcgagatcgacgagttccagaagggacttacccccaccggattctgtccgatgaccgacgatcgtatccaagagaacaaatctttctcgtatgccatattcacgccctcgggacgtaaaaagaataatgaggcgattatcctgttgcatggcctgaacgagcggacttgggaaaaatacctcacatgggcggaatacctcacccatacgaccggtaagccggtcatcctgttcccgatcgctttccatatgaaccgtaccccgggattatgggccaatccccgtgcgatcctcccttgggtaagcaaacgcaaggaggaggtagcgaacgtgacgaactccaccttcgccaacgtagccctcagcagccggctatcccaaaacccgttacgcttttacgcctcgggcagagagtccgtttataatatgtggcaattggttcatgagatcaagaacggcgagcatcctttgttcaaggaagatacgtccatcaacttattcgcttattccatcggggcgttactctcgcaggtcttgttattagcgaatccggacaagatgtttacggacacccgtttattcatgttttgcggtggctccatcttcagtgagatggatggcaacgcccgtgatatcatggacaaggaggcgttcgccaaggtacgccattacttccggcatgatttcttggagaaccgtacgcttcctacctcgttcaagaatgattttctggagcaagcctttaaggccatggtacgtgaggatgtgttacgagattaccgggagtcgttcttccaacgggcttgcgatcgtattcgggcgatctcattgaaaaaagatatcgttatgcctactggcggggtgatcaaggctttaggaaaagcgtccggcaagatattggaagagctggatttcccgttcgcttactcccatcaaatccccttcccgacacactcccgtatcgatccgggcctgatcaaccaagcctttcattccatattcacgagggcggcggcgtttctctaaagggacatcaccgcatttaaggcaagctcaacagacaacgttgccagcctctcagctggcaagcatattgtctgtcttcggctatcccccttcacctctgtacgtgccccatatttattttatgaatacgatgcaaaagaacagagaaataagaaggtccgcaaatccgtaacgttagtatccactagtccccgaatagtatttacttctttcatcgatagaaatttaattccggctacccgacatgaacatatccttcgtatatttgttgaaaattaaaatcaagaagatatgggaacagagaatacaggaacaagccaacgagtgcatcacgggcataacatcgcctccgcccgtaggatgaaaggtttagtgcaaaaaactttagcggatctattgggtatgtcccaacaacgattatcccaaatcgaaagcaccaaaatcgtaagcgatgagatcctgcaaaaagtagcggagatcacaggcgtatcgctcgaagatctgaaaacgatggaggagccgatgagtatctatattgagaataatagcaccaacacgattgaaaaaggggcgaatgttggtagtgtcaattcttcctatgatgaaaacgataacgactttgagacaacctatcacgttaacccaatcgacaaaatcaccgaactctatgagcgtctacttaaagccgatcaagaaaagatcaaggaactggagcaacgcatcgccgagttagagggaaacgcctccaagtcctaacctaccaacaacaatatataaaacattcttagcttttagccgtccgtatccatcgcatgataagcgtttcagctaagggctttcattatacatcttattaccatggaagaaaaactcgatttcgcgaatgtgccttctcgatactcattatgcttgaaccgccagtgcccgaacgccgccacctgccttaggcaaatagcggaggtaagcgctccagacgacgttgagtgctggactatcatcagccccaaacgcttggcaagcctcacgggggattgcccttactaccgttccaataaaaagacccgttatgcgatggggttcataaacatcctagatagtcttccctacaagcagatgcaagaggtcagcaagtatctgatctctcatttcggccaaagcacttattaccgtgcccgcaagggaacccgtccgctcttaccaaccgagcaacaattcgttctcgaaacactaaaaagatgcaaagcagacagttctcaagaattcgatgcctactatgaggactacgactgggagtaattcattttttcaccgtgatgaaaatgtatttccaccgtgatgaaaaaggtttttcaccgtgatgaaaacgttttttctccacggtgaaaaaagatcttcatgcaacatcacgtcaagcccgatcaccgacacttttttaaggtttgacgaacccgatcggattacgaggtttatccgacagtttcttttgtgtttgcaattccgccagagtctggttgattagctctagctgcataccaacacagaagaaagttgggcaacgccatgctccgtaaaagcgaaaggcatgtagcgaattcctccccgactctttgaggtcgcaaattgcgtcctcaaagaaacatattcttttttcgtcagttcaaacaaaaaatcgctaaacaacctttatccagttatttagcgatcatccatcgtggtcccaccagggcttgaaccaaggactccctaattatgagaccgagaaattaacctttttactgtatgccatctcatacaatacatttagatttgcattgtaaatcaatcgattacaatttatatttcatttgatttagttgcatttattccgtcacggatacgtcacggggtatacaaaatcaccaaaaacgtcacggaaacgtcacgctttttttgtgtcagaaaaatatacaatgcgaagaaatacagcgacaaaaggttttaagttcaaactctatcagaagcgggcaaacggtcggtatgccgtgtcgctcgtcttgcggtataacggtcaacgtctattaatcagcttgcctttcagtgcaacagaaatgcaatgggatgcaaataaagaaagatttgtagatgacgaaactgcccgaaatatcattaaggagcaaaagttaaccggagaagataagaaaaaatttctttccgaacttcacccagaccgggaagtaaacaacatgtacttggataaaaaaacggcagaactcctatccatcgtggatgactatgagcgtaggcgcatacccttcactaatatgatgatacaggaacggttgtttgtagttctgaaatccagtaccgttgaaaagtacctattatcccatatcgataaattgaaagtaaataatcgtcatgaaaaagcctctacttttgaagagctttatatatgcttgaaaaagttcgacaagggctttagcaaaagattattcccagacatcgattatgagtatgtttcccgcttcttcgaaaatgaaagaaactccggtcgtgaagttggtggtatcgtggttaatctacgtgccttgcgcacattattaaatagtgccatcaaagagaatgttggtagccctgaaacttaccctttcagcaaccaatacggaacacgtaccggaaaagacgcattcggtttagcgaaagaagtaaagaccaatacaagaaaacgttacataccttttgagtacctaaaagcattctatgaattcgaattcgagacagtgctacaccaacgaagcaaaggatttttctttttctctttcttctgtggtggcatcaacttcacagatatggctaatgtcaaacagacagatataaagtctggcttcgacagacaagggaagcctattcgttatttcacttatactcgctccaaaacaaaagagccgattgagatacaaatcaatgaggacattcaatctcaaattaactatttgcttaatgaggaatttggcactcctgctactgggtatctattgcctatcatcactaaagaagacatgtctcccacagaactgaatgatttcaagaaaaacaaacgcaagaagctcaacaagtatttgaaagagatggctgccatcatgggatttccagaaggcattcaagacctcagtacatattttccccggcatagcttcgccatgcgcttattttcaaaaacaaagtctattgatattgtaagcgcagggcttcatcattcgaaacggagataacgaaggtgtacctgaagccattttggaaggatgaagtggcaaatgtgactaataatctattaggtttaaaatgactttgatttagttgaaggatttacatatttacttgtaaaaagattttgcacgctttagtcctatagagtttgctcacaagatatttgtgtaaatcaatacttctatctatttttgtaaaaagaaacacatcaaaaatatgcaacgtattgtaatacaaaattttggtccgatcaaagatgcgaccattgaaattccgaaatttcttctactaataggagaacaagcatcgggtaaaagtactgttgctaaactcatttactttttccgctctttgaaagaagattttactaagagaatgtacaaacaacctactagaggatattcatggaaaaatgattttgaagttcctacaagacagaagttcatacaattttttggcagaccaaatcagcaatttgaaataacgttctactacacgcactcaaacaccgtttcaatcaaatgggacaataagactctctgtattgaaatgagtgatatatttaaaaaaatattacgaggagttcctaaacctcaatatatagttttggttagtaacacaaattctagtgatatcccacgaattgagcgaacttttaatgattctgaatttgtagaaacaatgaataagtgtttcggtacgatgacacaagattcactttatttagtagcagaacgtagttcaatggttcgttttggaaatttatttgagcgtttattttctagggaactggagtcaaatctacgtaaaatagcaatcactcaaaaccaggctatagaagagattcttttaatgcaatttttggatcgtgttgcattattgaaagattatttttccacatctaatcgacaacattttaccagtaatgatgcccgattaaagtggatgcttagttgtatgtcttctattttaaaaggcgaatactcaaatcaatctatagaacgtataagttggggtaaggactctaaagattccgtttttctacaaaacgcatcatctggtcaacaagaggttatacgtattttacaagattccatttgggttattgagcaaaacatcaaagcattcagagttttggaagaacctgagtctcatctatttcctcttgctcaaaagagacttttagagttcctgtcttcaatggttaatgcctctgaggataacactctagttatcacaacacatagcccctacatattatcttctgctaacaacctactttttgcttcgtatgttgcttctacttttccagagctcaaagatattatccaaagtaaaataaaaaacatctcatggattaatccatcagagtttaaggcttacgcattggacaaaaatcaaaaaatatattgtaaatccattgtagacactaaaacaggaatgatttcacagaattatcttgactcagtatcagacgagctatcttcagagtttaaccagatttacaaattatatatatctaaattaaaaggaacaaaatgagtccatatcctatttctatcacacaattaagacttctatcttcctttaacggatttgcagtcaatattactgattgtctaacaatacattcagatgaaatattttatgcttatgatgacaaagcactcaagtattcagtctgtacaaatagtattccctcagaattattgctaaatcaagaatattttacaatcaaaaatgacagcaagaaaaatattattttttggagtattgatggtaaatttatcacaaaaagtaaaatgcaaaaatgtgattgtgctatatttgatgaaaatactttttgcctagttgagtttaaaacagattcagaaggtaaatctactgaaacaaaggaagatattataaatcatgctcaagcacaaattattacaacatacaaacttatagaagaaaaaatcaaagctaaaggcgttgatttattagataaagttacaattgaaggacatatctgcttatctaaacgttatcctagaaaaacctcagaagaaatgagcttacaagctcttttcgctgagaagaacaagtttggtctattttttgatggaattaaagaattttaaacaaaatcacattaaatatataacattttcaacaattaaaaagtttcaaatccatctaataaggacgttctttccaaaaatcattttcaataaatttagaaaagtagactttcctgtgttattctccttagaaacaagtaccagtattggcagctttgtaattggcttcatgtaaagaagttgcatataatccaaccccaactcataatactccccaaagatgtgcctgataaaacctagtgtaacttgacagtttccctctattggcaaacattctaacggttcgtacaaatttaagaattcacctatcactggcttataattaagatgagacggaattatacagaacccatcatacttggggatttgggctatataatctttcccataatcctgacatatagtctcataagtccaaacttttctttcagttttcgtatcaccactaggtaaaggcgactccactactttgtaatagactgttcctatgcgcaaaaatttatttttttccatatccttgcaatcaatcctcaccttcttttctgtagaaaactttcatccaaacgagctaaagcctcttctgtagtctctttcctgtttgccaagagccaattttctaactcttcacgcaggaataggatttttccatttcttttgaagtgaggtattgctcccgtggatgttttacggtaaagggtagcccacttataaccagttagtttaacagcctcctctatacctattattttgggtggcatatcatcagctttagtactactatctttcaccgggactgattgctgcaattctaagaactgctcgatggttaaagtaaataacggtttgtctttcaaatcggataatgtttgtgcattcatattatgttctatattaagtttgatttgctggcacaaacttacaggactatgaatgggtatgcaatgaattcagtggaagactgtgtaaaatattttattcaatcttccagctaaacatttgtttttttatgaaaaatagcagtctgattaattcgctcttctatacccaatatttgctcatacatagcttttaccagcaggaaagacttcaacctctcctttatcaacttttcaagagctgtagtattagctgttttcttataagccagcaagtcaaaataatctatataacgataaataaatgagtagtcttcttttgtaagaggaacatcggttaaccgtgaatatgatatctcagtaaacaaacggtctaatcttactaaataagacaaaagccttattgttgtttggctttctaataagtccaaaggcgttaaaaatcctctttttgtcccatttagtttataatcctcttcacgagtagccgcaagctgtgctgtattctctctaaattcacatcttctggacgagtcttctgaccatcttgccgggcattctcaaaagcacatatttcttctatcaaaaattttatcactacatcttggaaccgttcttcattctcaagatacagcttcccgtttttcatctgttctgaagttagtatattatatgtataaggttttaaggctaacaggtaattttctaactgctccaacatctttctccatttacagacatctctatcttattgcagaaatttttcttgcatctctgcagttttacacttatgtgattgatatcttgtaaaagcaccatatatataaaggtacctcctatattccataagagactctggaaggtcgaatgttcgcagaaacagattgtaatcctcttcgtcaaaaatatagtctaacggttctctgacatacaaaccacaaagcttcactttcgtttctacagtacacactttagccataaatctaatccaatctaattaaaatataaagcccaaaagtaggagaagtacaaccaaatacaagtgcagaagatgaaaatttaacgtttgttgcgtcacgaaaacgtcacggggcataaaaaaagcagctacaatcttcattgtaactgcctgattattaagtagtggtcccacttgggcttgaaccaaggactccctgattatgagtcaggtgctctaaccaactgagctataggacctgttcagagctaggctctgaaatcgggtgcaatattacgatttattatcgagatatgcaaatgttaaagggaaaaacttatttttccgagctttcttctccggcgaactccatcaagtatgctttgatgaaatcgtcgatctttccatccatcacaccgttcacgtcggaagtctggtagttcgtacgatggtcttttacgcgacggtcatcgaatacgtaactacggatctgcgaaccccactcgatcttcttctttccggcctccaccttggcctgctcggccatacgatgctgcaactccttatcgtaaaggatggaacgcaattgacgcatagcgttctcacggttcttgggttggtcgcgagtctcggtattctcgatcaagatctcttcttcctcgcctgtatacgggtccttgaactgataacgcaagcgaactccggattccaccttgttcacgttctgtcctccggcgccgcccgaacggaacgtatcccaagagatagccgccgcctctacctttacctcgatcgtatcatccaccaacggggtgacgaatacggaggcgaaagaggtcattcgtttaccttgggcgttgtaaggagatacacgtaccaaacgatgcacgccattctcgctctttagatagccataggcataatcgccctcaatattgaaggtcacggtcttgataccggcctcatccccttcctgatagttggcgatagagatcttataaccgttattctcagcccaacgctgatacatacgcatcaacatggaagcccaatcttggctctcggtaccaccggcacccgagttgatcttgagcacgcagctcatttgatcggcctcgtcacgaagcatattgcggaactccaagtcttccagtaaatgaagggccttcttataagccgcatccacctcttcctcggtgataatctcttcctttacatattcgtaagccaactctagctcctcagccgccgcatgtacctcaccgtaaagctcgatccatttctttagctcctttactttcttcatctggacttccgcacgtttggcgtcttcccagaaaccggggtcttgcgtacgtagctcctcctcttctaactgaatggtcttgctatcgatgtcaaagataccccctcagcgccttatcgcgctccaacacgtcatgtagttggtctgatgtgatcatatgttcttttcttttttaaatttaccgcgaagataagaaatagttgatagccgacaaactcgttattcctcgtacatcgcctctatctcggtagcgtacttctgcaatacgaccggacgtcgcaactttagcgtatccgtcagctcgcatcccatcatgaagggttccggcaacaaggtaaagcgcttgatcttctcgtaagaagccaagttcttctggtgctcctctaccctagcctcgatgaaacgaatgatatccttgttcttcaccaactcctcccggctctcgaacgagatgcctttttccccggcatacttctccaacaatggataagccggcacgatcaaggcgctcacgaacttacgttgatcgccgataacagcgatttgctcgatataattatcaccgctcatcaccatctcgatcgcttgcggggcgatatattttccgtttgaagtcttatacaaatccttgattcgttccgtaaagaataacgtattaccctccaaacgaccagcgtcgccggtacggaagaaaccatcctcggtgaaagccttcctcgtttcctccggtttattataatacccggacatcacggtcttgcctttcaccaagatctcgttattccccggatctattttcacttgaactcccggcattacctcaccaatagaaccaaactggaatccgatctccgggtagaaacaaaccgtagccgtcgtctcgctaagtccataaccataagcgatcgggatattcacggactgcaagaactcattaatcgtatccgataacggagcgcccgccaccgggaaaaaccgtccacgctcaatacccaataccttcttcaataaggtaaaaaccgttttattgtaaaattggaacttcaacttcagactacacggggccggaatacctttattcttatactccagattataccttcgcccagtctcgatcgcatccaagaaaatcttcttcatggccggagaggcggagttgatcttctcatgcacgcccgcatacaccttctcccagaaacgaggcacattgcacatcaaggtaggatgaacctccggcaatgtcttctggatcattttcgggtcttggttgatagcgatcgtaacccctttatggagacaataataacaccaagccttctcgaagatatgagtcattggcaagaaactcatggatagatccttgtcggttaccagaggcagacgtacatcatgtatccgcatcgcctccagatagcaagaatgaggaagcattacgcctttcgactcacctgtcgtaccggacgtatatataatggtagccagatcctccggaacggcttccgtcatacgtattttcaccgtgctctccgcatgcgcgttatcccccaagcgcaagaaatcatcaaaataaatggacgtcttatcttccggattcatcttgaccgccggatcaaagacaaccagacgctccagatacttagagtccttctgtaccttgaaagcgttattatactgcaattgctcacccacgaacaacgtgcggatcttagcgtcattgatgatgtactcgatttgtcccggagaattcgtcgcatacatcgggatggaaaccacccggttaccatacgcaccgaagtccgtatataaacactgaggcatattctgggaataaaccccgatattctcttgtacctttatcccgaactcagccatcgccttggccgtaagcataactttatcggaaaactccctccaagaaatcttcaaccatttccccgtagcgttatctctatgtttcaacgctgtacggttcccatatttctctgcctgacggtgtattaactcggcgaaatgataataaatcataattccttattttgaattgataccgcgaaagtacgcttttctcttctaaaagacatgacatcagtcctttttttacacataattgctctttttgtgcaagtattcggttaaataataataattcatagtagcatgtattgcatagtacatatgtaatacatacatttgtagcataaaattaaaagagatgaatgcagagaacgtaaaatcacaaatgaggaaagggacgctggaatattgcatcctcctgcttctcaaaaaggaacccgcttacacctctgatatcattcagaagttacaagaagcgaagttgatcgttgtggaaggcactttatatcctcttttaacccgactaaaaaatagcgagctattaagttatcagtggatagaatctacgcaaggaccgccacgcaagtattaccaactgaccgagaaaggagaactattcctcggcgagctggaggcttcatggcaggaactaaatgatacaataaaccacatcagaaacaattaaaacgaaagagtgatgaagaagacacttactgttaatctgggaggcacagttttccacattgacgaagacgcataccaattattagacaaatatctgtctaacctgcgcatccacttccgcaaagaagagggttcggatgagatcatggatgatttcgagatgcgtatctcggaacttcttaacgagcgtgtccgcttaggctacgaggtcatcacgatcgagcaggtagaggaagtgatcaaacggatgggtaagccggaagagattttcgaggaggaagagaaaagcaccgaccacgaggataattaccgggcacaacaacaggagactcatacccagacgaccaagaaacgcttgatgcgtgacccggataaccgtattctgggaggtgtcgccggaggtttcgccgcctacatggattgggacccgactgccgtacgtatcgtgcttttccttctgatgttcttctatggaatcacggttccgctttactttttgctgtggatcatcgtaccgatggcacgtacggcgaccgagaaactcgagatgcgcggacaaagcgtgacggtggagaatatcggaaagaccgtgacagatggattcgagaaagtcagcaataacgtgaacgactttatcagctcggataagccgaggaacttcttccaaaagctggcggatgttttcgtcttggtcatcgggttcatcctgaagtttttcatcatattggccggaatcatcttattgccaccgctagtattagtcgtattcattctggtagtcgtaacatttgcgttgctcatgggtggggccggattcatctataacctctctccgttcggagcggacttgataaacggagcaccgctgtcaatggcaatcatgggatgcatagggacgatcttattcatcggcatccccatattctccctgatatacgcgatttgctgccaattgttcaaggtacgtcccttaccgacgcaagcaagatggatattattagccttatggcttatctcctttatattatgtggtgtatatatccatcaatccggtatgctatatgactggcataattattggaacggtgtacacgattggaacaggaatgccgtttggctcccttaaccttatccgaaggcgtaaaatgaagatatagatttagtagtttataatgtttattgtgtgtttaaaaaaagaaggccgctctgtcacagaggggcctttcttctaaggttaacaaatttatgagtaaaaaccactaatgaatcatattaatgatttgctgtcccctttgcatgatattgtcacgcataaaacagcgggtacaaatataaccaattttttataattaaaaaattatattcaattatttgaattcttttctaatcttagcggcgatctcggccaattcttcttggcttacagccaatttcttcccgccgaaatacatatcggactccttcgtgataggaatcaaatggatatgcgcatggggcacttccaagcccatgacagccaaccctacacgcttacactcgatagcggtctcttgggcacgagctacccgtttagcgaaagctaccatccgtcccagcatcggatcatcgatatcaaagatataatcgacctccttcttgggaattaccaaggtatgccccaaggctaccggattgatatcgaggaaagcaaaaaactcatcgtcttccgcaaccttgtggctagggatctcacccgccacgattctactgaaaatagttgccatacgtctttctgtttttaaattgaaatatccataatctcaaacgtcatcaagccggaaggtacacggatctcaacgacatcccctaccttctttcccatcaaaccttgggcgatcggcgtgcttacggagatctttccttcttttaggttagcctccgaatccgataccaacgtgtaggtcatgacagcgttattcttcgtattcttaattttcaccttgttcaaaatctgaacctcatctgttttcacacgactctcatcgatcagacgggcgtttgagatcaaaccttttaactgcgcaagcttagcctccatgataccttgagcctctttggcggcatcgtactcagcgttctcagataagtcacccttatccctcgcctcagcgatctgggctgatatttcagggcgcttcacggtctccaaatagttgatttcagctaaaatcttatcgtagccgtcctttgtcatataactaacagccatattaaatcctccttattctttatattaatattgattgattatcgcataataaaaaagaatcccgaccaagtcatatggccggaactccccttttttatcatttcaagactccgcaaagttaggttatctttctaagatgaacaagtttacgaaagtgctttataacatataaatctgatgattaaatcatgaacattttacaatacggacttgatgtcagcctcaagtttcttcacgtcgtccacccgtttaaccaagtttcccttgcgatccaagataaagatcgccggaagctgtttcacgttatacaacgccgcggtctgagagtaaacagactgtggatcacgcacgcaagtccaaggtaaattagaagcggcgttcttccagaagtggacatcattatccaaagagatctggtaaatctccaagcccttatcgtggtacctcgtatataaatcgccaaattccatattcaaggcaggagaccattcggacatataggccgtgaagttgatcaacaccaccttacctgtagcgacagaagacaatttcgtgttttccccatgtacatccggcaactcgatatccaagaaactaacctctttcttctccaccttatccaagtccatcgggcgctggctacgaatcacctttatcgattgaagagccaagttatacagatgcttagcacgagggctttccggataatagtgatcgaagctggtggctacggcaccataagccttcgagtcgttcttgtcatacaaatcgaagaacagcaagccgtcgatttgctggaacaaggcaaagtaagcggcagcggacatcggggcggaataaatatacttacgagccacgtccttataagcctcggcggcctcgagcacctgacgggaatatacggaatccgccaacagaccggactcagactctttccgtaaacgatggatcgcttggttcgcgtctaattgagccaaggtaatattcttgatcgccttgcaattctctgagccctccacgctataagaagtagcgaaagtcccggcatcggccacgaacgagatcgtctccgtagaatctaccgagaagttgatcaattggttattcagacgcaagcgataaaaatccgggaatgccggacgaggcttcgtaaagctgaatttaccggccgccgtcagttttacggagtccatcaactctaccgtcgacacacctacattctccagatacatcatctggccatcagcgccggacactacaccttccaccgtaaaatcagaattcttcttacaagccgtgaacaaaagcaacataacacacagcacagctagtaaattcgtagatatttgtttcattattccagtttgtctatattactaatccggtgcaaatatacattattttacaattgtggcactattattccgtatttcttcaaggcttttttcaaaaaaagtatttcaagactgttatttcttttcattttcatgcaattacaggtaaactttcattacatttgcaccaatttttgacagatagaaaaataagaaaaaagattatgcttaatccaattaacaagacgatcgagttaggtgatggaagaaccattaccatcgaaaccgggaaattggccaaacaggcggacggagcggttaccgttcgtatgaacaacaccgtgttgctcgccactgtttgtgccgctaaagatgcgaacccgggtgttgacttcatgccgttgcaagtagaatacaaagagaaatactccgcttttggacgtttccccggaggttttacaaaaagagaaggaaaagcttctgattatgaaatcctcacatctcgtttagtagaccgtgcgttgcgtcctcttttcccggacaactaccacgctgaggtatatgtaaatattatattgttctccgcggatggcgaagatttgccggacgcattagcaggtttggccgcttccgccgctttggcagtttctgatattccttttaacggaccgatctctgaggttcgcgtagctcgtacggatggaaaatacatcgtcaacccaacttccgcggaattggagaaagctgatatcgacatcatggttgccgctaccatagacaacatcatgatggttgagggtgagatgaacgaggttcaggaatctgagatgcttgaggctatcaaggtcgctcacgaggctatcaaggtacaatgcaaggctcaattggaattatccgaggcttgcggcaaattggtaaaacgcgaatattgccacgaggtaaacgatgacgagttgcgcaaggacgtacacgacaaatgttacgccaaggcttacgccgtagccacatccggtagcggcaagcacgaacgcagcgaggcattcgagaaaatcgtagaggaatacaaggctcaattctccgaggaggagttgacggacgagaaactggaaatgatcggtcgctactatcacgatgtagagaaagaggctatgcgccgtgccatccttgatgagggcaagcgtttggacggtcgtaagactaccgagatccgtccgatctggatcgagacagattgcctgccgggtcctcacggttccgctatctttacacgtggagagactcagtctttatctacggtaactttaggtacgaagtctgatgagaaaatgatagacgacgtattgaaccatggatacgagcgtttccttttacattataacttccccccgttctccacaggcgaggccaaagcaacacgtggtgtaggccgtcgtgagatcggacacggcaacttggctcaccgtgcgctgaaacgtatgatcccggacaactatccgtatgtagtacgtgtaatctccgatatcttggagtctaacggttcttcttctatggctacggtttgcgccggtaccttggcgttgagagacgcaggtgttccgatgaagaaaccggtatccggtatcgctatgggattgatctccgagaacaagggtacgaactacgccatcttgtctgatatcttaggcgacgaggatcacttgggtgatatggacttcaaggtaacgggtacgaaagacggtatcacggctacccagatggatatcaaggtagacggtttgtcttacgagatccttgagaatgctttggctcaagcgaaagagggtcgtatgcatatcttgggcaagatattggaggctcaaccggaagctcgcgaggatttgaaacctcatgcacctcgtatcgagacgatgattatcggtaaagaattcatcggtgcggtaatcggcccgggcggtaagatcatccaaggcatccaagagaagacgggcgctacggtttctatcgatgaggtagacggcgtaggaaagatcgagatctccggcacgaataaggctacgatcgacgcggctgtcaaggcgatcaaaggtatcgtggctgttcctgagatcggagaggtttatgaaggaaagatttcctctatcatgccttatggtgcgttcgttgagttcatgccgggcaaggatggtttgcttcacatttccgagatcgactggaaacgtctggagaccgttgagcaagccggcttgaaggaaggcgatacggtttctgtcaagttggttgatatcgatccgaagacaggcaagttcaaactttcccgcaaggtattgcttccgaaaccggaaggttacgaggaacgtccaccgagaccagaaagaggtgagcgtggacctcgccaagatcgtggagatcgtggtcctcgtcaggatcgtggtgatcgcggacctcgcagggagtacagagactaagataacgtcttatacattatatataatcccgggtagattaaacactatccgggattttttttatcaaatcatctaccacacctacaactatagctataatcaattggtcataagttatttatcgggtggtggtagataaatagcatctaccactattggctcgtatctaccaccatttactacttttcaatcacaaaacaccatcgtcccctactcgccaaccgcattattagtcctatctttttcaagaagcggcagaagacggagacattgcttagccggcaagctatctatttgatcatgcttcatatatcatctaaaaaactgattaattgatatttatagtttttcttagtataaaacaaaagttttccgctatggaaacatttgtttcctcatgaggaaaccttagttttgtgcttacgaaactttagttttccctaggagaaactgtttgctcttgtatgttaatctattatcatgtatctctaatctgaacgcacaagtatttaaattagaaaacggcttagctttttcgaaattacaaacaaaaggagtcaaaggtgcaaatatagatttatacccccataagttaacgacttatcaaatatcattagatatcgagtatttacaaacaaaacatttctatttatcaagttccattggttaccttgaaaaaggaggcaaatatacagacattgtaaatcaatccatgagtgagagacatatcaatcagtatataacaatacaaaacaaagaaattctcaacatcctcatcactaatttttatgttattactaaaattaccggatagcaaacctagtacagactaaacaaacgaccataaaccttatatccaggccatgatcatcgtttagcctgcacaaacagtaacgtttaataaatataagcgtaattccaagccaaagcattcaaactgggatcccatcgattccactgacgccccagcatatcatatttaacttgatatgcagccgttttcatatagaatctattacctgtttgaccatctaccgcacaacctcgcagtcccccaccaattgagttcggatcaaatccacattttggagactctttagttactcccagggttccgtccggaagggtcaccatttttctaacaatatagatatcacaaaagtaataaccagtaggaatatttgtaggtgatttgttgataagaacttttttattttcttccactaagaatgtgttatcatatcctgtcacactaaaagtctcactcgtagccttagtctcaattaatggggattgttctgattccataaattcacccataagttcaataaactgattccacgtaattgcaccattagcttccgcacatttcctcaaatcttcttcactcatgttatcatagtcaagaccatctcctacgataacctcttcttggttagaacaagaagacacaaaaaacaaaaacaaacatgataaaattagaatctttttcatacaaaaaactatttataaattaaacattgaataatcaaagaaattaaatattacaaatcatcctcacattcaattttagaaaagaataaaaaactcttcatagatgttgtctccttctactcttattaaataaggtttaaataaaagaccttgcatggaaatacaatagctctgagaagtagaaagaggtacagactcttcatatacgagcatcccactatcatcaacaatttgtataaacacattgtctaatggcttcataaaatagaacatgattccatcatttacaatcttcacttctaccggattaggagaaatagagcgctcctcttcctcatcacgctcattcttatgctctcttccagccaccgtatgtgtccataagcatacacaactcaataaagtcaaaaataaaaatcttttcatcccattcattttttgactgcaaaagtatccgataaggttggattcggggctaaaacactgttcgctttttgttcgctttttgttcgcagagttgtataagactaaagatcagcgattaattcatccagttcattcggggttccatcctctccctttatttttttataaagccgtttacgggatgaggatacggagggtttggagcgacccaagatttttgccatatcagttaccttgactgatatctttatcaagtaacaaatccggagttctatcaatgacattcccgagtatagctgatatagacgattcgtaaaattattgtatgtcttatctaactccttccgtaaagcattccaatcttcttccctgattatctgatctgcctcattcgtggaatggaatttcatatagatatccgaatgccttaaatccgactctaacaaatcacgctcggtacgccgcaactgtatttgttcattggtcacttgcaaaagttcttttcgcacatgaagcaatgaatttgtatcttcatggtctttagatagtaaggttcccaattcattcaatttcgcgttattcgcttctacatattgaaaacttctctcatattgttcttgcttttcccgctgaagcgcctcaaactgcctagccaaccgctctttctgccgtttcagtctatatataaacaataaggttatcgaaagccccaatccgaacaaggataatatccggtaaatacgaatctgcatccggtcattctcgccctttagccgtaaattctcagtttcccgcttttgataattatataaagaggtcattttacggatttcctccgaatcggttatcttgcggatggtatcttgcacttgctggccaagacgaacatagcgaatagcctcccgataattcaaccgacgctcatacaaaagcgacaagtactcataaatagcgtctctaacatataaatcgggactatccaaacatctccttaaatagtagtcggcagagtccaatcttcccacctctaaataaatatgtcccaatgtagaataagtaggatacatattccggcctacggaatcttttaatgattcaaacaaacattccaatgccttatcatacattcccaattcccggaaaagatcaccctgctcagtcaatataccggaatatcgatgtctattccctgtttcattcgctataattgccgctttttgaaaatagagaagcgcactgtcattcttatcgaccatatcatatacccgggcaatatctctcagtacaagagacaaactggtactatccccctccaaaagctcatactctgctgctttctcatgcatacggatcgcctcctcatacacattctgataatcataaagcatccccatctgcgaatagacattggacaataatcggtactttctcgtatcccccgccacatccaatgccttttggaaatacttcaacgcttccggggcatcgttcagatcccggtagacacggcccatatagtaataagactctagtaatttgtctcgatcgccatatgtctcatagaaagcggtgattcgtttaattaaggaatcggatgtatgccggacatacatcttatcattgaccttcaagttaagtaaatcataatacatacgctgttcctcatcaaaggacgaaaggctatcccgcaatcgatccaacaaagggcgggcttcctccggatttgtatccgcaagggattcgatccgtgacagggtagcggggtaaggcttcccccgatgatcgcaagcataaaaagccgagatcaagaccgacatcaagaggatgtatatacgaggcattggaaatctgttttatcacttaaacgcaacaaaggtaaaaaattaaagtgtaatagtttcattgatatttatacaaacttttgaaaaccaatacgcaaagtacgctacgaccggatacttacaggttttgctttctactcttaacagatctgggtactttttgctatctatcttaaacaaatcgtatatttctcattcaatcaatcagcgtatggatagcctatttattaaacaagaacgattactggcacaaacgagcacccgtatcataagaatagcggatctccccgattccttcatcttggctgacaatatggagttcgccaccggcaagaaactaccgctgtggatcgtgggattaacctattaaaaaaacacgtacgtctttttttaagaacaaaaaagcggtatccagcttgccgccggataccgcttttcatttatctttaccgatcaagaaatcagcaacgaggcttgatctgcttgaagaagtcattacccttgttatctaccaagataaacgcggggaagttctctacctcgatcttccagatcgcttccatacccaattccggatattccacgcactcgatgctcttgatattgttctgagccaagatagccgcagggccaccgatagatcctaggtagaaaccaccgtggttcttacaagcgtccgtaacttgctggctacggttacccttcgccaacatgatcatgctaccgccatggctctggaacaagtcaacgtatgagtccatacgacccgcggtcgtcgggcccatagagccacaagccatacctgccggagtcttagccgggcccgcgtaataaataggatgatccttgatgtattggggaagatcctcgccacggtccagacgctccttcagtttagcgtgagcgatatcacggcccacgatgatcgttccgttcaatgacaaacgagtagataccggatatttatccaattccttcaagatatccgccatcggttggttcaagttgatcttgacagcgtcgccctcacccgcttggcgaagttcctccggaatcaattcgccgggatggctatccaacttctcgatccagataccttccttattgatcttacatttaatattacggtccgcggagcagcttacacccaaacctaccgggcaagaagcgccgtggcgaggcaaacggatgatacggacatcgtgagccaaatatttaccgccgaattgagcgcccaagccaatattctgagcagcggccaatacctctttctccaactccacgtcgcggaaagcacggccaccctcgcttccggtcgtaggcaagctatcgtagaaacgagtagaagccaacttcaccgtcaataaattcttctcagcggaagtaccgccaatcacgatcgcgatatgatacggaggacaagcggccgtacccaacgtcttgatcttctctacgaggaagggaaccaatgtacccggattcaagatcgcttttgtctcttggtataaataagtcttattggcggaaccacctccctttgtcacgcaaaggaactcatactccatgccttccgtagcctcgatatcgatctgggccggcaagttacatttcgtatttacctcgtcgtacatattcagcggagcgttctgggagtaacgaaggttctcttccgtgtaggtcttgtaaacacctaaggaaagcgcttcctcatcgcagtaaccggtccagacctgctgccccttctcaccgtggataatagccgtaccggtatcttggcagaaaggaagtacgcctttagccgctacctcggcgttgcgaaggaatgtcaaggccacgtacttatcgttgtccgtagcttccggatcgcttaggatcttagcgacctgctcgttatgagaacggcgaagcatgaatgatacgtcgcggaaagcggcgttagccatagcggtcaaaccttctttagcgactttcaagatcggttttccttcaaactcagaaacggaaacataatcttttgtaagcaaataatactctgttgtgtccggtcccttttggaacatcggctcgtagtgaaacggaggtgttgccatatctttagaatttaattatatattggttttatttaagtttgtccgtacttttcgattggcaaacttagcgaaaaaacttgatatatagatcatggggtaaagaaatatagttatatttgcccgatatgaaaaagttgacctctttatacattgtattcctgctaacgatgctaggttttcaaggaaatctgaaagcgcaggttagccacggaggccgcccgcttccgctatcgctcatgcgaagtacaaacgaacagatgtttaaagaaatgcctccgttcgacgttcaagaggaattgcgtatcgactcgctgaatgagagcgacctaagaagcggtttccgttttgcctataaattcataacggattacaatcggtacaactcgggcgtaactttcaccgggccggatgggacacgtgtatggagactcgggatctactcgcccggggccctttccatcaacgtgctcttctcggaatatgaactgcccgaaggcgcccagctcttcctatataatgaggaccagacacagatattaggctcgttcaatcacctaaacaactcggagttaaacctattgccggtctctcctatccaaggggatcgcctgatcatagaatatcaagaaccggccaacgcctcttttcaaggaagactgaccgtcggggaagtcaaccatggctaccggagcttgcgggggttagaaccgggagacaacacctcactgatcggtaaaattccaccgttagcttgctatcaagatgggacaaacgattacgcccaatgggggcaaagcgtcgttctcctgatcatagacggaagtgtagggtgcacgggcacactgataaataatacggacaatgacggaaagccttatctactcaccgcctcccattgcctgaacaagcaattcacgatgaaaaaccccgattatgagaaaatagccggaagtatcgtctgctttttcaacttcaacagccctttctgcgacccgatcctaaggggaacggaagagatgtctaccgcatccacttacttcaaggcggttaatgaaatggcagacatggccttgttggaacttaccgccacacctccggtttattacaggccttattatgcgggctggaacgcacaagaggtaggacctgccccctatacgtgcatccaacatccccaatactcggtaaagcgaatcagtatatccgatgaggatctggctccctttaccttgacagatccaaacatgattttttacgagaacgctcatttacatgtcaagacttgggaagtaggttatacggccagcggttcctccggatctcctttattcaatgccgacggagagattatcggagcgttatccggcgggcagtccagtgagaatagtccgaagaatgattacttcttctctttgaagaaaccctgggacgcgatcgatacccccgagagacagctcaaatattggctaaacccgtccgatgacgagaccaaggtttgcgagggacttgatccgtataaatcaaccccttgtttccggttgagcaacatctatgactccggtaatcaagaaaacgccgaatgtacgctctatcccgggtctgaaaaagcgtatttgttcgggaacaaccccgccaatatcactgaatacgcggaagcttaccaagtagccaaagcgggtaccttatacggaacttatttcgtaacaccgcctgccggagcgaattacaaacaaatggaagtggaagttaccgtttacagcggtgactctaagccctctacattattatatacggaaacattccaacccacctacagcaataaatcgatattggacgatacgtttattgagaccgctaaatccctaaatcggtcacaggaaagttatatccatttctccaagcccgtgaacgttagcggaaagttctacatcggctataagctcaagagcgtcccggagaacacgtatttctccgcttacaatttgcccaaaggcaaaacgacccggaatacggcttgggttcatgataaaaacggctggagacaagctaccgaatatacgcaagcaggttttagcacctccttgtttatcgatcccgtcattcaatacggtaaccccgtcagcaacgaaaagctcgaggcgaacgagcaggtactcattcatctcggtccggagaaaggcatggtacaccttgttttgccggatggaatagagaaagcgacttatacattgcactcggcacaaggaaaagtgtcggaaaacggagagatcacggacaggcaagctacactccatttcctaaaattaacatctggagtctactttctaaccgtgcactatggcgaggagcattatacacaaaagattatattttaatcaaaaaatatacaataagacttctgggaaaccatccattgaaaagaatggcaagaggtacagagccatattttttcaataattctacccatattttatgtataaaacaagcctaggattcattaataagtattaattaaaaagattttatcgcttctttgctatccataacaaaaaaatactttagttttgcacgataatggctaagggataatttggaagtgaatatattaacatagtaacattttaaacttacatcaagattatgaacaaaaagtttttattgccattcttcgtattggcagccattttaactctttcttcttgttcaaacaagttgaaaccgttggcagaacagtacattaaagcagagccgcagccgctagaggctatcggaggcaaagttcctgtaacgatcaacgcgactttccccgctaaatggttcaacaagaaagctgttgtaactgtaactccggtattgcgttaccagggtggcgaagcttggggcacttcttacacttaccaaggtgagaaagtaaaaggtaacaaccaagtaatccctcaaaaagaaggcgctaacgtaactatgaagtcttctttcacttacaaacccgagatgaaaaaatcagaattgtatttgactttcgacgcgaagatcaaaaacaagactgttaaattgccagacgtaaagatcggtgaaggcgttatcgctacttccgaattggcagacgcagctaccgctacagcagctatcgcagctgataaattccaacgtattatcaaagaggctcatgacgctaacatcatgttcttgatccaacaagctaaccttcgcgctaaagaattgaattctgacgctatcaaagaatggaaagatcttgttaaaaacgctgacgaggctccgaaccagaatgtagctatcgagatcagcgcttacgcttctcctgatggtggtttcaaattgaacaacacgttggctgagaatcgtgaaggaaacactacgaaatatttgaacaaggaattgaagaagatgaaggttgacgctccggttgacgctcgttacacagctcaagactgggaaggcttcaaggaattagtttctgcttctaacttgcaagataaagacttagtattgcgtgtgatctctatgtaccaagatcctgagacaagagagaaagaaatcaagaatatctccgctgtttactctgacttggctgagactatccttccgcaattacgtcgttctcgtttgactgctaacatcgagatcatcggtaagtctgacgacgagatcagcgctttggcaaagagcaatccttctgagttgaatatcgaggaaatcctttacgccgctacattgactaacaacgacggtgagaagatggctatctatacaaaagcttctgaattgtatcctaactgctaccgtacttggaacaacatcggtatgatggcattcaaggctggtgatttggctaaggctgagcaaatgttcaacaagtctaactctattaagaataacgcttccgctaacatgaacttaggtttgatcgcattaactaagggtgaccaagctaaggctcaacaattgttcggtaacgctgccggcgtaaacgaattgagcgaggctcttggcgttctttacttagagcaaggcgaatatgctaaggctgttaactctttcggttctgttaagactaacaacgccgctttggctcagatcttggttaaggattacagcaaggcttctcagactttgaacggtgtcgctaatcctgacgctgtaacttcttatttgaaggctgttgttgccgctcgtacgaacgacgctaacggtgttatcaacaacttgaaggctgctatcgccgctgataagaacatggctaaggaagctgctatcgacttagagttcgctaaatacgcgactaactctgacttcgcagctttagtaaaataattagaaaatattctttctaaataagaaaaagacctcatccttttggatggggtctttttttatatcccaccatccaatcctacatttgataaaagcgtaacaggttgaaataaatactgattatcaatgatttttcatgaaataaattcgtagatttgcaaaatctaacaaagttgttgtaaatattaatcaaatagggtaaagaaattatgagatcacaaatctggaaacaaatggtgtgggtattttgtctgctctttctaatggggtcatgcgttaaacatgacatttttcaaggagaagaccccacggtagatccgaaagaacctaccaaagaagaagaagattacatagcccagttcgagaatttcgagaacatacaggttaacatatcttctcagcatgaagggaccgtatattctatttattacgaatatccttatgaagagggcgctttagtcaaggagtcttatttaagtggtaaaactccgatccatatggccctggaagtacctacacacgtaaagaaactctatatcctaagaggagatggggaacttatcgagagtgatgtaaaggacatcacgatcggcagcgataccaaaagtagtttacgggctacaagtgcgatcagtgatgaagtccttcatttgatcaataacaaatactttccagaaaaggcatacaatgtaaaaagcgaggatttatatagatgctctgatctaaaaatcacggaaaccgtttttaccagtagctttgagaaagcggatatttggctgacctatataagcgatggaggaatgtccaaagacaatatgtatggtaaaatttggttctatacatatcccttcgagaagatggagaatctcactttagacgactgcaccttctatggaaagactaatggcaccatccaagtcattgacttcaatatgatcaaccaaggcgagaattatatcttttactccaaagaggaacagccaaaggctaagacaggagaatatacccgaatccccctaggaagattcgacaaggggctcaacgtcggcttcgtatatcgaggcacagaccgtccacagttctccactccggcattaaatgggccggataacaataaagtaccagataatgggacattctcccataattacgtaggccataccttaaaatatggtaattcctctttcaaaatagagaaaaacgtagcaaacggcttcattcaccacattcaagaaggtgattttgaaggaaatgtactgggaatggaaaatcgctgcccaaactatagggcctatgatggagactacaacgatatgctttgtctaatcgaaagtaatcccgttgccatcgagccggcagagccggtaacccctcccgtcatagaatcgcaaacgaacaagaaaggattcctcttgttcgaagataattatccaaaccaaggcgatttcgatttcaatgacgctgtcatatattatagcatcacagcatataccgataagagtaccgcagatgtttatgcccagttactggctaaaggctgtacattccacaaccaatttggatttaaggacgccaatggactaactccctttttctccgatgtcaatggatatgtcaatgtgagaaaattcgacaaggaaccggaaagtgggattacaaagacattaacatatagctcaactcaactgatcatgccttacattgataacgggaagggaccggtaagtaaaaacgtaaagaatacggatctatacccatatgtgttggatatcccttattcggaaaataaacctttccattggtgtatagagaataagagtattgacgatgcctataattttgatcaggattaccgcaaagcgcacggagattggtatgagactcctaaagatgaatcgcttgtaataaaattcacgacttcggatgaagagaagaaagatccggaaaataaagaatgaagttgcgcaaacccattgaaggatctctaaaatcctataacaagtaaaaacggcggcctttttaaaaggtcgccgtttttatatttattcaatagaagaatttatctaccttggcgcttgcgctctgtctcatccaagatgatcttacgcatacgcatattattcggggtgatctctacgtactcatcgcccttgatgtactcaagcgcatcctctaggctgaatacgataggaggagccaaggaaaccttgtcgtccgaaccagaggcacgcatattcgtcaacttcttggatttggtgacatttaccaccaagtcattgtctttggtatgctctccgaccacctgtccagcgtaaacctcctcgcccggggcgatgaagaaacgcccgcgggattgcaagttattcagggcataagcgaaagcctgacctgtctccatagcgataatcgaaccattcatacgtcgttcgatatcacccttccacggttgatattccaagaaacggtgtgccatgatagcctcaccggcagaggcggtcaatacagcgttgttcaaaccgataataccacgggaaggaatcgtgaactccaagtgcatacgaccattcttgctttccatcatggtcatctcgcccttacgcttcgttaccatatcgataatacggctagagcattcctccggaagattcaccgtcaattgctctaccggctcacatttctcaccatcgatctccttgatgataacttgaggctgacctacctgcaactcgtatccctcacgacgcatcgtctcgatcaatacagacaagtgaagcacaccacgaccatataccaaccaagaatcagcggaatcagtaggaactacgcgtaaagccaagttcttatccaattctttctgcaaacggtcaaaaatatgacgggaagtaacaaacttaccatccttaccaaagaacggagaattgttgatcgtgaaaagcatagacatcgtaggctcgtcgatagcgatcgttggcaatggctccggctcgttcacgtcggcgattgtctcaccgatctcgaaaccatcgataccgataatagcgcaaatatccccggactgcacggaatcaactttcgtacgtcccaagccctcaaatacatccacttccttgatcctcgatttcaccatactaccatcacgcttacaaagcatgacatcttggccctctttcaactcgccacggtgtacacgtcctacggcgatacgacctacatacttagaataatccaaagaagtaatcaacatctgcggagtaccctccaacatctttggttcggggatatacttgatgatcgcatcaagcacagccgtgatatcctctttcggctccttccaatcctcggacatccagccctgcttggcggaaccataaatagtagggaagtcaagctgctcctcggtagcatccagactaaacatcaagtcgaataccatttcctgcacttccgacgggcggcaattcggcttatccaccttattaattaccacgatcggcttcaaacccaattgaatcgctttttgcaaaacaaaacgagtctgcggcataggcccctcaaaggcgtctaccaatagcaaacaaccatccgccatattcaagacacgctccacctcgccaccaaagtcggcgtggcccggagtgtcaataatattgatcttatatcccttataattgatagacacgttcttggcaagaatcgtgatacctcgttcccgttccagatcattgttatccatgaactgatccggttctgcctgtccttcacggaaaagcttaccggctaataacatcttatccacgagcgtcgttttgccgtggtctacgtgcgcgataatcgcaatgtttctgatcttttgcattgaagactaatttattggctgcaaaaatacgatatttttacgatatatatatgacattcatgcttcaaaacacaaaaaagatagtagaatctattgcaaatcaaaaaggaatgcctacctttgcgaccgcttagataacatagtattaatttattaaagtaaaaagaatcatgtatttagattcagcgaagaaaaaagaattatttgaaaagtatggcaaatcagcaactaacacaggttctgctgagagccaaatcgcattgttcacattccgtatctctcacttgacagagcacttgaaagtgaatcacaaagactacgctacggaaagatcattgaagatgttggtaggtaaacgtcgtcgtttattggactatctgatcaagactgacatcgagagataccgcgctatcatcaaagaacttggtatcagaaagtaagaaaaagcttatgcgagaatattaaaaagggcaatcccaatcgggaattgccctttttatttgccttaatcctagatataataaaatattaatgtaaatttgcgccgtttagtatcaatttatcaaacattataggattataaataacaaatcatatacatgggaaacaacaaaattataggcgcaaaaattaaaaatatccgggaatcgaaacagctctctatcgaggaagtagccgaacgctccgggttaggtatcgaacagatagaacgtatcgagggtaacttggattttccatctttggcccctcttatcaaaatagcacgggtattaggggtacgtttgggtacattcttggatgaccaagcggagctaggcccggtcgtatgccgcaaaaaggatagcgaggccgatggtatcgggttcacgaacaatgcgacacaagggcacaagcatatggattaccactcgctctcgcaagataagtccggccgccatatggagcccttcttgatcgagatcgctccctccgaggaaggcgaggatttcattctgtccacgcatgagggagaagagtttatctacgtattgagtggcgtcgtagagattaattacggaaaaaacacctatatcctagaggaaggcgatagcatctattatgattctatcgtggcgcatcatgtacatgcggcagccgacaacagggctcgaatcttaggagttgtctatacaccttattaaatccggcgttttatggaattacataacagaacccttggccaatggctggaacattgggccgagaatacaccggataaggagtatatcgtttattcagaccgtgacttacgtttcacttggagcgaattcaacaagcgtgtggacgacatggcgaaaggtatgttggcgatcggtatcacccatggcacacatgtcggcgtatgggcgacgaacgtaccggattggttgacattcctatatgcaggcgcgaagatcggtgccgtattggtcacgatcaatacgaactataaacaaagcgagctggaatacctagtagagaacgccgatatccatacgatgtgtatcacagacggcgtatttgatggaagttacgtggacatggtctataccatgttgccggaattgaagacctcccaacggggatatttgaaaagcgagcgtttccctcgcctgaaaaacgtagtctatatcggacaggagaaatacaggggtatgtacaatacgcccgagatgttgctcctcggacaaaatatcaaggatgagaccttagaggctgccaaagcgagagtaaattgccacgacgttgtcaatatgcaatatacttccggtacgaccggcttcccgaaaggggtcatgttgactcactacaacatcgccaacaacggtttcttgacgggtgagcatatgaaattcaccgccgacgataagctttgttgctgcgtacctctctttcattgctttggcgtggtattagcttccatgaacgtattgacgcatggatgtacgcaagtgatggtcgagaaattcgatccgctattggtattagcttctatacataaagagcgttgcacggccgtgtacggcgtgcctaccatgttcattgccgagctgaaccacccgatgttcgagatgttcgacctcacgtcgttacgtaccggtattatggcaggttctctttgcccggttgaactcatgaaaaccgtggacgagaagatgcacatgcgtgtaaccagcgtgtatggattgacagagacctcaccgggtatgacccactcccgtatcgaagatccggccgaggtgcgttataatactgtaggccatgagttcgaatttaccgaggtacgggttatcgacccggagactggcgaggaatgccccgtcggcgtacagggcgagatgtgtaaccgcggttataataacatgaaaggttactataaaaacgaagccgccaccaatgaggcgatcgacaaggatggtttcctgcattccggcgacttgggcgttcgtgatgagaatggaaacttccgtatcaccggccgtatcaaggatatgattatccgtggaggcgagaatatctatccacgtgagctggaggaattcctttatcatttccccggcgtgaaagacgtgcaagtagccgctgttccttccaagaaatatggagaggaagtgggtgcctttatcatccttcacgatggtgtgacggctacggaggaagaggtgaaagatttctgccgcggaaagatcgcccggcataagatcccgaaatacatcttcttcgtcgataccttcccgatgaccggaagcggaaagatacagaagttcaagttgaaagacctcgggctgaaactattgcaagagcaaggtatcacgccggcctgacgatttagtggacagctaacagttgacagttactttaaaatcttcataatgggcggtacgatcttctcgtgttgcccattttcctaaagaacgatggacggaatcaacacactgcgttactcggatttatttttagcgatgtatttcgatggcgggaagagctgcctgcaccggaatcattcgcatgtgttggtgtatgtatattccggagagatggtaatcgacgagaaaggccaaatcacccggttacataaaggagaatgcgctttcatccgcaaggacttcagtgtgcagatgacgaaacaagcatggaatggcgagcagttcaaggcgatcttcttgatgttcaccatgaagttcctacgcgacttttacagcaaattagatcgaaatactctccctaaagacgccaagcgagatcaggtaagcctttacaagctaccgtccaaccgtcccgatatcgtaagcttgtttgagtcgatgaccccttatttcaattccaagatccaaccgacagacgaattgctgcaactaaaaatgatcgagggcgtttatgtgttgctccataccgacaagaatctatatgcctctatcttcgattttaccgatccatggaagatagacatactggaattcatggagcggaattatatgaacgatatttccatggaagaaatcgccaactatacgggacgcagtctctccacatttaaacgtgatttcaagaaatgtagcgctctctcgccccgggaatggctcatccgacgccgccttgaagccgcacatgggctgatacgtaaaggggggcgtaaggtctcggagatttgtttcgaggtaggcttcaagaacctttcccatttctcgaaaatctataagatagcgtatggcgtaccgccaaccgaggatatataatatttataatgggccacacaacaaagctatttgaaccacataacaaagcctctataccactccctccttatcttcgcgacataaataataacaaaatgtaaatcaaatgatcatgacaaagacaatggaagagaaagtagctttagtaaccggttcagcgatgggtatcggactcgcttgcgccgaagccttcgccaaggctggatacataaccgtattggcagacatccgtgagccgggagaacaggtagagaaattagtagccgagggacataaggccgtagcgtatcggtgcgacgtatcaaacacgcaagccgtaaaggagatgatcgactggaccgtagctacctacggaagactggatgcggctcttaacaacgcaggcatacaaacaccgcaacgcccaatggcggaaatcaccgacgatgaattcgaccgtaccgtggctgtggatttgaaaggtgtctggaactgcatgcgttatgagatcctgcaaatgctgaaacaaggcggcggcgccatcgtcaacacctcatcgcaaggcggagtcacgggatttccggggcaagcggcctacatagcctgtaagcatgccgttatcggactgacacgtaccgccgctatcgactatgcggcaaagaacatccgcatcaatgccgtatgtccggacgttatccgtacgccgatggcggaagacttaatgcggcgtgacccttccttggagaaggagctggtgcgcgacattcccgcagggcggctcggtaagccggaagagatcgccaacgccgtactttggctatgcagtccgcaagcgagcttcgtagatggccatgcgctattggtagatggagccttcagtattcattaaatcgcaaaactacagagaacccaatactgcaacggcgttgcagtgttactgcaatgcgggttgcagtaacgaacccaccgtacccctcagcaagcctctgccctagatggaaattcatagataaagaacacctactatcaacgctttttcgtaccttcgcgtctcaaccatttatagtattaatttatgtcacaattatttccaactaatctgccttataaagtggcagatatgagtttggctgaattcggtcgcaaagagatcgagatcgccgaacacgaaatgccgggattaatggcgctacgccagaaatacgccgatcagaaacccttgaaaggcgcacgtatcaccggctcactgcatatgactattcagacggcagtgttaatcgaaacattagttgcgttgggagcggacgttcgctgggctagctgtaacatcttctccacacaggaccatgcggcagccgctatcgcggcggacggcgtaccggtattcgcttggaaaggcgagacgctggaggagtattggtggtgtacggacatggcgcttcgtttcccggaaggtaaaggccctcacatgattgttgacgatggaggtgacgcttccttgctgattcacatgggctatcgtgcggagaacgatgcggagaccatcaaccgcaaaggcgggaatcatgaggaacaggtaattctagatacattaaatcgtatccttcaagaagataacagccgttggcaccgtacggtagccgagatgaaaggtgtgtcggaagagacgaccaccggcgttcaccgtctgtatcagatgatggagaaaggtgagttgctggttccggctatcaatgttaatgactccgtgacgaaatccaagttcgataacttatacggatgccgtgagtctttggcggacggcatcaagcgggctacggacgtgatgatcgccggcaaggtggtagtcgtagccggatacggtgacgtaggtaaaggctgctctcactccatgcgctcttacggggctcgtgtactcgtgactgagatcgatccgatctgcgccttgcaagccgctatggaaggtttcgaggttacgaccatggaagaggccgtgaaagagggtaacatcttcgttacgaccaccggaaactgcgatatcatcacgatcgagcatatgacacagatgaaagaccaatcgatcgtatgtaatatcggtcatttcgacaacgagatccaagtggacaagcttgtcaactatccgaatatcaaacacacgaatatcaagccgcaagtagacaaatatacgttcccgaacggaaactctatcttcctgctggcagaaggccgcttagtaaatctgggttgcgccacgggacatccgtcattcgtaatgagcaactcatttacgaaccaagttcttgcccagatggatttatggcaaatggcctatgaggtaggcgtatatcgtttgccgaaacgtttggatgaggaagttgcccgcctgcacttggaacgcatcggcgtaaaactatcccacctgacgcaaaaacaagctgattatatcggcgtaccggtagaaggaccgtacaaggctgatcattacagatactaattaattgaagattgaaagttgagaattgataatgaagggagggcagctcctatagttctcgattcttaattttcaattttcaattcttaattttcaattaccatgcgtttcgctattctctcccccatttatccctatcgtggcggtatcgcccaattcagcgggatgctctatacggaattagtaaaagaaggtcatgaagtaaaggctttcaacttcaaacgtctttatccggatatcttatttcccggcaagactcaatacgtagaagcgggagaccgtgcgatcgaaatcgagagcgtgcgagtattagatagcgtcaacccggttagttatttcagtaccgtaaacgccattcgttcctatgcgccggacgtactgattatctcttactggatgtcctttttcgttcccggatacgcccacgtagcgaaccggatgaaaaagcattgtaaggtaatcacccttatccacaacgcgattccccatgagccgcgtttcttcgacaagcctttagcttcgttacttttcaagcaatgccatggctttatcgtgatgagcgataacgtgcggtatgatttgcggaaactttacccgggcgctaaatatatccagaacccacacccgctttacaatcatttcgggagtaagatcaacaagaacgaggcgtgccggaaattaagaatccatccgtccaaaaagaatcttctattctttggactgatacgggattataaaggattagatctgctgatagaagcgatgggacagcttaacgaggattaccatctcattatagccggcgaatgttacggtagtttcgagaagtatcaggctctgatcgatgcatctccggcaaaagaacgtatattcgtccactgtgaatatatcagcgacgaggaaatccccatttatttctcagcggcggatgccttagtactcccctatcgctccgccactcaaagtggtgtcgtatccgtagcctacaattacgatttacctatgttaagtactcccgtaggcgatttcaagaacagcatcgaaaagccgggtacaggcatcgtagtgcctgagatatccgcgacggccctcgcccaaggtatcgaggaacttttcaccccctcacagcaagccaccatccctgcgaacatatccaaagaaaaagcagccctctcgtgggaaaccctaacgagaaaactgctcgattttatcaatagcggtttcatctagttgtagagacggggcgtgccccgtatctacaaccaaccggaatttatatctctttttgctttctagctttccaaatcgaatatcctaccgcaccaatcaataacaacaagataatcaacgaactgaaagaagtaatataagccgccgtaatataaccttgcggtctaaactcaaatacgatctgatgctctcccgcaggaactaacatagcccttaatatccaatccgcccggaaatgcggagcgggcttcccatcaatcgtagcctcccatcccggttgataatagatctcagagaatactgctaattgctcagaattagtcttcgtcgtataaactaacttattagggcgataactatccaatgttatcgtagcggtagagtccaattgaggcgtgaaacctttcacctcatcagcgaaacgtttatcgacaaccgccgtcgttaacggattgatcgtattcaacgccgctatttccgcatccgcattctccacgacctccactttatccacaaaccaagcgttgccgaaagcaaacggattcctcaaaggcggttgctccggattatagataatataacgtgtatttagcatattcaaggacgggcaagcagcgaacgcccccatcaaatcctccgcggtctgcgctttctggaaagccccgataaccgagttaagctctccttgcagacggtggtcgatcagttcttggtaccgtctcagcttcgccgcataataaccaccgacggaatggtgatagtacgaggtcgttgtctccaagaaaggattattcaaattcaagacacgataagaaaggtccttatccttcatgatttcctgatcggctaccgtctctttatatatctccgtaggtttctggcggataaagttactatcgttcaaataccgtttatccaccgtccataagtcaaccagcatcaagaccgcaacaccgatccctacgaatgtcgccactttcttccgatctttcgaggtatagaaccagaacaacaaagccgcccctaataagataaagaccaaagagcgcaacgcatccgccgaagccaaggaagcacgatccattaacaaggcgttgtaataccaatccggcaactgatattgagcgtcgaaagaagaacggaaatccaacagcatactcggcatcaaccaaaggattaaagaaagcccccccgtgatagccaaagcagcgatcaatcctctcttcaacaaggcatcgctcacggtctcggataacacctctttcaatccccatatagcgataataggaaacaccatgcccggaataaccaatgccatctctacggtacggaacttattatacatcggcaagtaatggaacataaagtcattgaagctatcaaaattacgtcccaatgccagcaatatcaaaaagacagaacctccgaataaccaccatttcatcggattccggatcacgaacattcccagaacaaacaagaagcagaccaatgccccgaaataaaccggcccggaagtaaatgtcttctctccccaataagtaggagcctgtacctcttttccgacttgagcgcctttcgcccttaattccttatataactcagaatccgggcctagcattccacccgaacttccaccataggcattcgggaccaacaaggtcaacaactccccttttccatagctccaagcgaacgcataatccttgtccaagccggaagagatcttctcgcccgaaggggtcgttgtcgttaattccgtagccccacggatagagttctgtcccaaatcccattgagcatacatattctgggcattcggcaacaccgccaatatcacgcatccagccataatagcggttaccgtacctagttctttataagctttttccttcagtttattgaacaaatatcccaaataaacgaagaagcaaagtaataataaataataagtgatttgcaggtgcgtattcgcgatagagaaagcgacacccaacaagaacacgaccgccccccataaatacttacgcttgaacaacagggccatacccgccaacgttaatggcatataagcgattacatacgctttcgtgacatggccggcctctataatgatcagattataagatgctaaagcgaaagcgatagcaccagcgatcgccaaccaccaatttacgcccatgacacacatcaagatatagaaacaaacgaatccggtaaacaccatccccgcatccatataccccagcgcttttaaaggcttctccactaaaagatatccgggaaatcgtggagccggatttccatatcccgacacataaggcattccgccaaacatagcatcagaccatgcgctgaattctcccggttgggccgtcttctcatattcatccatctggctattccccataccgatagccttttccgtatccccttgccggacgattttaccctcaaatacggccggagaaaaataaatcaccgtcaataccaagaatacggctatcgctgcgatatgttttccccatttactcattatactccgcataaaacttatctataatttattgtttatactctacctttaaaccatttggcaaaatagaatctcacggcgaaccaaccatgcaacagaatcgtcgacaccttgccataatacttacacatgacctcatatcgctcctttaaggaagctttccggttcacactacttaacccttcctccaaaaaattagacaggatcaaacgtgtattatgtattcttttcgatcgtctcagacattggatacaccaatcataatccgccgtcaaacggtattccgtattatataacggagcgatctcccgttttgatataaacgactggtgacaaaccaacattcccatccgaaaacttttccaagtcagtttctccggtgctttcaatctgcgcatccctaatgatctaccctccgcatcaacgatccgggtttctccgtaaatcacgtctggcaaagatactttctttttcaaagacgccacaattctttgcacggtatctgcggtataaagtgtatcccccgcattcaggaaccacacataatcccctgtagcccgcttcaatcccttattcatagcatcatacaagcctttatcaggctcgcttatccaagaagcgataccggactcatattgcttgatgatctctacggtcttatccttcgacgctccgtcaatcaatatatactcaatattcggatacgactggctaagtacgctcaatatcgtacgctccagccatcgctccgcattataggtgatcgttatgatcgaaaatgtaggttgctgattcatttccattatctcttataaatttccgacttgtctcacacgatatttttgtaaaggatgcttaggagaagacggatataatctctctagtagcccatcctctaacattcttggtataacccgattaattaaataagaagcctctctatgaacagcttccgctattatttccagagctacataatcctcacaaacagatagtattaacctcgacaaatcctcataacgcatatatttcttactttcatccttctccagtttgctttcatctttttgaggcttgctttcatccttcttcagtttgctttcatccttttgaggcttgctttcatccttctccaaaaacagcaaacggtacctagttccccggccatttcctatagactccaaaaaaccagcattgcacatacttttcagtagctttgtaatatttgagctatgttggttcaaaatatattgaagtctttcattagatacttgtttttcagagtaacaaagagccaaaaccgtgaattgatcatatggaattctttcaatttcccgtccaaacagacgcttaagttcttctaagacttcctctggatacaaactttccatcggtaaattcaacaccacccgatccgggtgactttgctcctctacaaatggaggtctccaattcgcatttttccaacccataaaaatcttattcaccccacttcctgctttctcagagaagccaatcaacataaaatacgagaatctctcggatgttcctcatccgcatcggcaatcattctgcgaacttccgtatccatatatttataatctccctcattatttcgtttataagtatgtccatttattccatttttccacaaatgtagcaattttcaatctatggtatgatcaaactacgatacaaatcaatatacctcctcgcaacaaccgattccttataacaatcatgtacattgcggatacaagcctcttttaatcgcaaaggctctcgattatcaattacccacttgatacccgtagccaagtcatccgtatccttatatttcgccagatatccattttccaagtggtttataatatcagtctgcccgctattatcaaaactcaccgccggacaaccacaagccatcccttctataatagtctggccaaaagtctcatacaaagaagctaccaccgtcacgtcagctgcggcatataatttcgcaatcatagaaggatcactcaaagatcccatacatacataaggaatcggaatttccgacaaaaaagaatcatctcctttgatacctccaaataagaccaagaaataatcttcctctcctttcctctctttcaatatagataaagccttgacaagatattcaaaacctttaatcggatcattgatacgtgcggctcccatcaagatgattttcttatccaaaggtaaagataagctcttcctagcctcctccttatcagaaggtacaaacagacttgtgtcaatcacattcggaatcacctctacaggcaacctattggtcaacgcactatcttgagcttgttgtcttaaccaagtacttaccgccaccagttgtatcttagaatccgccaaaaaacgtttcttattaaaaacatgatacgacaaatcctttttatcgctcgaacttaggaaagggcattctccacattctttcttgaacctctcgcaaccgaacgaataatggcaaatcgccgtacatggccacatatcgtgcatagtccatacgatgggtttcccgatcagcgccagctttcttatatccgccaaagacaagaaaccttgattgatccagtgtagatggatcacatccgcagccttcaccaaggggtgatcagacaaatccgtacccgtattggctatagagacctgaaacaaaggctttcgcctgaaatgattacagataaaaataatcaaccgctcccacacgaaccgaataaagttccatcggctcgcccaaaagctatcattaagagcagtcacccactcatcccccgtcttccgatcacgcaccaacatagaaacctctacaccggatttacccaatgccttcgccagccggttcgccgctactgccgctccaccggttaattcagaagtatttaatatcaagatattcatttttgctctattatttgccaaaaccatctttcatgcaaaaggttcgttcttataattcatcaccgatacataaagtaacgaaaataatcgctacaagagaccggaaaatagatagctcgtaatactgaaaaggataaatccttttcagtagaataaaatattttattccgcaaacgcacacacaacatggccaaccgcattctggcctgcacggaatgtttgctttgatagaaagccaaacatagagcattcgttctcgatatagtatcagctggaatggcggacaacaactcataaagcttggaaaagtaggcatccattccctcacgtaccttaggatgtctataatacgcaaacgtacggcacaaataatccaacatattcataggagtcttcgcatagttcattggctcactatatgtaacagcttgcaaatgcctacgctgattgaccaacacccgatccagataaaccaacttctcatagctctccactacgatctggaggaaatggtcgtataagaaataatcagaccaatacgcccaatccggtatcttatcaagaagagcacgtttgaacagcatcgtatgaccggcaatcatggaacaataaatcgttctttccaaacatcgattcgctactctctcatcaaaaaaagtcttaacaccattcgtgtccgagaaaggtctcgtcatgccagcgcacaaccaagcatcccctattgcctctacttgccattccagtttacgcggctcccaaatatcatcttggtcagatatagcgataaaatctcctgtagccctataaaaagccgaaaagaaatttcgattaaccccttttccggattcattcatatagaccttgataaagggatatttgcgctgatagccttgcagcacttcccaagttccatccgtagaatggtcatcttggataatgagctcataaataggatacgtctgtccaataatagactcaatctgttccgcaacaaatttagccccattatacgtacacatcacaaccgaaatagtccttccatccgtcatggcatcctgtcgattaatcatcaattgtcttattcgctttttcaaccaagctcgtcacctcctccaaggaatctcgatacatctcatagagttttccccggttctttatctcttggaaacccatcaaccctttattccagatccgcatacctccggcaatcatcgattcaaaacctgcgttataccagcctactttcaacccggatagccaagcccgcaaacacaactccgtatcatcacactggaaaggagcgaacgagaaatcaatatgccctaaatgttcaatatataatttcttattcagtaacataggcgccctattcaccgaatggacgaaacggaaatccttgcctttaaagaaagcggaaggataagagccgttatatccccatttctccttctcatcaatcacgaaatccaatccattcaaaccacccaatatagccatatccgaatatttcttaaaataggcgacacctttatccacccatccaagatccgtgatcttgtcatcatcctgcatcaagacaatatattcgccattcgcgaaacgaatagtcttgtcatacatcacgttctcatacaagtcgttggcacgcaccaaaaactcattaccacgagtaagatacctcataagagacttagaatgtttgtattcagagccatcatctattactacgatttccgcattcgggtactcacgtaatttgctgacaatacgctttacacccacacttttattatgagattctataataaagctgacaagcggttgattggtatatcctttcgccaaccaatcctcataagttttctgctttcttttaaaaacacgtttcgctaacgcccaataaactttctcccaatataaacgaatatccattcttacttatcctattatagagtttaactgattgaaaaaagaaattatgtattgatcataactataacccatcttattcgctttcaatgatatttgtctaagaccttcacaatcctccagaccttccgccaatttctccgcaagatccgttttagatgccggatcaaagagatcaccatttttccgtggctcaatcaaacaagccgctcccgcaacaacagaacataacgtataacaaccggctaatagagcctcattcaccaccgctccaaaacgctcataataacttggcaacacaaatatctggccgatattataacaagcatatagatcctctccctgctttttcccagcgaaaatcacgtggttagccaatccatttctctccgcatgtcgctctaaggcctctctctgatcaccatcaccaacaaataaaagaatagacttaggatatctttttaccaccaaggcgaaagcatccagtaaaaagaataaattcttgatatctattaaacgaccgacaaacaacaagacttgccttccttccaaatgatacgtatccttcaatatcctagaaacaggcaacgcattctccaatagcaacctaaagtcttgatctttttgtataatcggaaaaaacaaaaatttctgtcgtgtctgaaaacgctcaacataccaagacagcacatcatcgtttgtcaaaataataccactgtaaagcttaaccgctataaaacgcatacatcttttcacaagagttgcgctttctgcaatctctttgctatcatcacagatcgtaaaaatagacaatttccagttgaatagaaatttataaaccagcaataataaacccaagatattatactcactacaaaacaccacatccggctgttccttcttcaagatcgagagaacctgtgtcctaagattcttaatcccgaataatcccggagctagaaagcgaggcacaaactccaatcgccctctcaactcgtcttgagcgaacgattgctccaatacatctccaaattcaaaatagaatatagcatcaaactccttattcaaggaattaaaaaaatctacccgataaggagctatcgccggatgaaaaaccacaagtttctttttcatttcaaaatgcgttttatcttttcggagttccaaacctccatattcgtctccagtttcattttccaataagcccatcttttccgatttcccaacaaaagaaactgaaaaatccggatatagctcttcagttgcgtaatggcaaaaatcaatcgacacccaaagataccatagacctttctaaaataaatatattgtccctcatataagaaataaagacgggactgttttatataagaggcacgcccctccaaatgtgtgatttgagccgaaggtacggagtatatatcccaacccgatcgatgaatccggagacacaattctgtctcctcataattcatgaagaaatccgcatcaaacccccctatcgaagacaacaccgacctcctcaccatcaaatccgcaccagtaacagaagccacctttatcggcttcccctcatgattgaaaaacaaagaacgtctagacgaaaaacatagtgaaggtatatataagattcccaataactcccataaaaaagacggatatttacgactaaaagaagtggtggcgttcccctcttcatcatataggttacctccacaagccccgacattcacattaagttccagaaaacggaataattctcctatcgcattattccgtaaaagagtatccggatttaaaaagaatatatactttccatccgccttttttaaaccaagattattcgctcgtccaaaaccaacattcttttcagactgaatggttatcacgtccggatgtatttcttgtatcttagccaatgacccatcaccggagttattatctacaataataatctcatacaggattccctgtgttttttccttcaccgagttgatactatctatcagcaatcggctagttctatagtttacatatataatagaaacatccatatagtagccacacttaagaaaacaaacgcctcattcttgataaaccctttgccaatcgaggagaaaaataccctatatacaacatcaccgcaaccaatcgattcttgtcaagcacaaaccgttgaacgattttatcatttaaataaaaatcccttacatacccccgaatccgattagtcttatcttcattcaacaagcttgatcttaaataaaggcaacaggcacttaaagcacgatataaaatcctatggtatatttctaccttataagcatttacggccatcatatcaaaaaggccaactatataataataattttgttccgctaatttcctactatttctctcatgcattatagaggacgaacgttgaacataataataagaataaccacaacagcaataggctgaagagatattgttacaaagctgcaacataataacttgatcctctcctaatgttacattcgtaaaagagggacattgtatggccgtatcgtacaatgtttttgatatcaatttaccgcaaagactatcccccgtattatcgataatcagtttctggaattcttctctttctaaaacaccctcctcatggaaaaaactcgggattggggtgacaactccattttcttctttataaaaattagccacaactaaatccacggaatgcagaacagatttatccaacaagcactctacggcatcagatggtaaatagtcatctccatccaaaaagaacaggaaacgtccagaggctttttgaacaccagaaatcctagctcgatataagccttggttttccttatcaataagaatcacacgaggatctttctcttgaaaggattgaataatttggagagattggtcttttgaaccatcattcactaccaagatttcaatgtttcgataagtctgagcgatacaagattctaagcatctaggtaaatactcctctacattataaaccggtataataatcgacactttttccataacctcaattctaacaaaaaatcaaaagattaatcatactgtaaatctccatgtggttttatttcctccatttgtttaaaagtaaattcacgccttccaagaatacgacagaacgcaaccgccataaagcgaacgcataaaaaagaattgacaaactaattttcaatagtaacaatatatatagattctcaatcttaatcgttaagacatataccacaaagaagacgaacaaagtaaccaccaaataaggtaacacatcttgcgccaattgtaccaaacggacacgaatcaatcgataaaccaaaagatgccacacaaataacataaatacataagtaagcacatatgcaacaaccatacaaagaataccaaaagatgcagtaagccataatatagccaattgtaatataccatggaacacattcgcatataaaaacgtatccgatttcccgtgcgagacaagaacttgggtatatagcaatataagcggtcctatcgccccttgaacgcacaatatttgtaatataggtacactctccaaccatttattgccaatcgtggcacagataaactcctcagctataaaagccaatcccatcatagctggaaacgacacgaacgcagcgaaacgaaccatcttgcggaatacattccgctgacgttccaaatcatcattcacttgcacgaatacaggttgcgccaccgaattgatcatattgttcaacatcgaacctcccatagtcatccacttatttccttgcgaataatagcctaacacattagcgttatataatttacccaacaaaacagaaaacacattattattgacctgttggaaaatattcgtaaggaacaactttacactaaacgggaacatctctttcagaggttcgatcgaaaaatcaagactaggacgccaagatacaaccatccatttcaacaaagatacacttgccacatacaccgtactttgaattgccaatgcccaataagcgaaaccattgaatgccaaaagaaccccgcatatacccgacaaaaacaacgcaaaaacatcaatcttcgcctgtatcttgacttgtaattgcttaaataagataacatgaggaacaatcgccattccagaaaacaaaaaactcgcaaatattacccgagataaattaaccagttcttgacgatcataaaatgacgcaatcatcggagctgaaaaaaaaagaacaatatacaaacagatgcttacaacaaaggaaaaccaaaacaccgcattataatccttatgagtagcatccaatttgttagtcaaggccaccgagaagccgctattaataatcgtactagcaattccactaaatatcgccaacatcccaaccaatccataatcctcagcattaagtgtacgtgccagataaataccaaacaacatccccaacaactgttgcacaccattgctcacccctccccagaagagccctttcgctgtcttatcttttaatgattgttctgccatttgatatttacggtaaaagtaccacaaagataatcatttacttattgtaggcatcataatcataaccacaaatcacacgggaacaatctttgttataaaatggattgataacactgcgtgttgaatcatattcctcaacacgtatatcagccagatcaatgatcgtatgtatcaaatcgtctgtcatataaggtctatccaccgcacaagcgatacaagaatctttttccggatacgaagctttaaagcgatctgattcccatataagaaatggcacctctaccatataacgagaaatattatcctctgaacgtcccgtataatcccgttcatcatatacttcattgccatgatcggataaataaatcaaaatagattccgtatcttccaacgtcttcacgatttcacttaaaacataatcattatataagactgtgttatcatattgagctgccatttctttagaatcctctccatacggaatagattcatcatctgcttgaaaaatctcaaaatgttccgggtagcgatttcggtaaagaggatgagagcccataaaatgaagaactataaattttttttcactcttatcttgcaacttgtttttaagcacagcgattaaatcttcatcaaaatccccatatctctcatctatagaatttctcttattattaaaataacaatcatcacattgacgaccaagtgacgccacgtaattaccataaactccgatcatctcttgattggagatccagaaagtcttataatcagcagctttcatcacatcaattatattcgcatggtcataccatttccccgttgattcattattaaaaaaagacatgatcttctgaattgacgcagaagtatacagactcggacaaatgacatcactaaatcgatacaacttatcttgccgatataaagaatccaaagaaggagtcgttggcaacgaataaccataaagactcatatggttacgtcctaaagattctcctataatcaaaactatatttctaatatgtgagtgattcgattgtatctccacgtcaacggatcccatccgcttaaagacaagttcatattgctctagatcatgcagtgtaatcacatagctatagtacaaacgctgaataggtaacatcgttttcatatgagggcttatcacgccctttcccagaccggaatccttcacgaaccggtaaccacctgcgcacagccccaaaaacaagacaacaagcaatacccacctcaaggctgccgcctttaaccatctacacgaagatatcctatccttcaactttcctttataaaaaacgcagacaataaagagtgccagccccaatacgatccatctcacattaccatatgtctgaaggaactctacagcctcttggccattggtctctaataatattaaaaccatagagggattgatcaccgtattaaaatttataagcaaaaacaactcaaccccacacaatagcaaagagatgaataacgatatagccactataccgatcttccaccaacgattctcaaatagatctttaacaaaggcgatcaaatacgcgaccaagaaaacatttacaaagccatgtaacagtttcgtaagaatagagattcctatttcatgtataatattattggcagcacccgttaacaaatttaagactaacaaaagaaagataaaaccaatgtttgttacccatacacgatatagcttatctacaattttccacatatctcaattaaagttgatatttacggtaaaagtgccacaaagataaacatttactcttgggtaacgggcaaaacccggaagcttttcatactttatgtataaaataacaaatagtacgtatggaaatatgaattagtatcaatagaaaacaccaattagtatcaatagaaatccggatttctattgatactaattaaaaagtctcgcacctactagatataataaactaataatcagaaatatacaaaacagacccattctaatatagcttattgtacatttttacattttactagtcttgcgaactaaaggaagcgaaacaggtactcgtagactaataggcacatacacggacattgacagacataaaccgacacagaccgatttgcctcatacggcttgcgatacctttgtcatgttttcgaaaacaaggtaattcatttaatcatcttttaaaatttagaaattatggcagtaaagtacagattgatcgagagaaagaacttgggtaacgacaagacagaaacacccaagaaacagtatgcgcaagtgatctatggagatcttgtagagttcgagactttcctcgaggaagtggcagatggaagtggagtaggctccgcacaagtcaaagcggtactcgaccgtatcaatatcgtgttgaaacgaaatctcgcgcaagggcgcagggtgaatgtaggcgagttgggcaatttccgttttggggtaggctctacgggagcccctaccaccgaggaatttaccaccagtttgatcaaagaacctaaagttgtctttagccccggaaaggccttgagaatagctaagaaactcgctaatttcgagaaaaaggaactctccgaaccgcaaaacggaggtagccaagacagcgaaagccctgacgagatctaaaatctcaatctctattcgcggtggatttatgctttcaatacgtaaatccaccgtattgtttccaatataaaacaaaaagcaagcggatgcgtttctacatcttaaacgtatgatgattatcacccgagacgagaaacgaaccatccaagtccaagagagaacgatcgaggtagtccctatctgggaatggattctcacgccttccccgcataaatcctccgtataatatccactaccttcataccttccaagacgttggtcgttatgatctcgccgggggcgccggaaaggacattgactacgttacggatcacgaagttgtggttttgggcggagcctttgtaagggccataatcattaccggggttggtaggggccaattccggcatctcataatccttgatatggcaatattctacctcattcatatattgaccgccgattttcacgctgccattctcggccacgatcagcatgctgctttccagattcttgtcccataccgccgtagagtagctcaaactgcccattccaccgttcacgaaattaaaattcacgaaaccggaatcctcaaaggcggtcagtttctcgtggttgaagtcggcgaaacgggtctggatattacagatatctccgaataaccagtacataatgtcgatgaaatgggagaattgggtgaataaggtaccaccgtccaaggtagcatcgccatgccatcctccgggtttatagtagcgttcatcacggttccagtagcaattcagctgcaccatataaatctggcctaattttccggactcaaccatctccttgatccagaccgaaggcggggaatatcggttttgcatcacgcaaaatacctgcttacggaatctcaacgaggtataaaccactttctcggcatccgccaaggtcaaggccataggcttttctatgaccacatgatgtccgctttctatcgcttggatcgccatctcggcatgtaaaccgttgggtgtacaaatattcaccacatctatatccaatcccaaacggaatagttcatctatattccgggcgaaagggactgcgtaagcctcgatccccagctcctctttcggacggatatcacacaaagcgaccaactctgccccttcatcccgggtaatcatctcggcatgacgcttacctatatgaccacagccgatcacggcgaaacgtatcttcttattcataaaacactctttatagattctataatataagcctgctcctcttctgtcatctccgtatgaatcggcaaggataatacggatcggctcaagcgagaagcgacattcaaatccccggaaatccggcatcgacccctcatcacctcctgctcctgcaaaggcaatggataataaatcatagaaggaatacctcgttcttttaacgctgcttgtacttgatccctcttttctacagctagctgtaccgtatattgatgatagacatgcgatgaaaagactgattttagcggtttgcgtacagttttcaatccggaaaaggcagcatcgtatctagcagccactttacaacgagcggcggcaaattcatccaaataccgaagcttaacatctaagacagcggcctgcaaggtatccaaacgggagttgcagcccaccaaagaatgatgatatttcatcttttgcccatgattggcgatcattcgcaggcgttcggccaatcgcacgtcggaagtaaacatcgccccaccatctccataacaagccaacggtttcgaagggaagaaagaggtcgtacctatagaggcgatcgtaccggctttctttaccgttccatccgagaaggtataattagcaccgatggattgggcattatcctcgatcacatataaattatggcggccagcgatactcaagatcgattccatatcacaacactggccaaaaagatgaaccgcaataatagctctcgtcttttcagacagggcatcttctatcttttccgggtctatattgaatgtaccgggatctacatccactaataccggcactaggccaagagccaaagcgacctcagccgcagcgatatatgtaaaagcaggaacgatcacctcatcgcccggatgtaagtctaatgccatcaaggagatttgcaaagcatccgtaccgttgccgcacgggatcgcataaggaatacctaaataatctgataaatggttacaaaatcccttcacctgagggccattgataaaggcgcaagcatttatcaccgtttgcatggcaggatcgatctcactacgcaaacgttcatactgcttccgcagatctaccatctgtatctgtttctcaagcatcttatccattcaaaaaatagggctatcccgtcgttaaaacggaatagccccctcattattgcgtttaccttattatttcacctcactacccggtttcacctctttctccggggtgataacggccagctttccatcgaaattctcggcggagagaatcatgccctcggaaacaatacctttcagcttacggggagctaagttagcgatgaagcaaacttgcttgcctaccaattcctcgggtttataatgttgggcgatgcccgatacgatcgtgcgtttctccaggccatcgtcgatacggaactgaagcagcttatccgctttcggaaccttcacacattccagaaccgtacccacacggatatccagtttcatgaaatcatcgaactcaatattctcacggatcggtttcgccttataattcgcttcctcattcgctttcttcgtatccaataatttctgcacttgggcctcgatcacgctatcctctatcttctcgaacaacaactctgccttgcccaattgatgaccggcctccaatagatccgtagcacctaggcgattccatcccaacggctctacattcagcatcttgttcagtttctccatgctaaacggcaagaacggctcaaaagcgatcgccagattagccgtaatctgcaaagcgatgttcatgatcgtagcgacacgaggcatatccgtcttcgccaacttccaaggctccatatcagcgagatacttatttccgatacgggctaggttcatcgcctctttctgagcgtcacggaagtggtaggtatccaacaggcgttccacgttctctttcacatccgcgaaatccttcaaggtctgacgatcataatccgtcaactcgccagccgccggcaccttaccctcgaaatacttatccgtaaggactaacgcacgattcacgaagttccctaagatagcgaccaactcgttattattacgagcctgaaaatctttccatgtgaaatcattatcctttgtctctggcgcattggccgtcaagacatagcgcaacacgtcttgcttgcccggcatatccaccagatactcgttcaaccaaaccgcccagttgcgggaagtagagatcttgtcgccctccaagttcaagaactcattagcagggacattctccggcaagttataagaaccttccgcttttagcatggaagggaacacgatacaatggaatacgatattatctttaccgatgaaatggaccattttagtctctggatccttccaccaagtctcccaactatccggcagcaactccttcgtattagagatataaccgatcggagcgtcgaaccatacatacagcacctttccttccgccccttctacgggaacagggataccccaatccaaatcacgactcaccgcacggggttgcagtcccatatccagccagctcttacactgcccatatacgttcggtttccattccttatgatcctccaagatccatttacgcaagaacggctcccacttgtccaaaggcagataccaatgcttcgtctcacgcatcaccggcttgctgccactgatagcggatttcggatcgatcaaatccgtcgggctaagggaagtaccgcaagcctcacactggtcaccatatgccttctcgtttccacaatgcggacaagtacccgtgatataacggtcggccaagaattgcttcgcctcctcatcgtagtattgctcgcttgttttctcgatgaattcgcctttatcatacaatgtacggaaaaaatccgaggccatctgatgatgcgtagcggaagtagtacgtgaatagatatcaaacgtgataccgaactcctcgaacgatttcttgataataccgtggtaacgatccaccacatcctgcggcgtgatcccctctttcttcgctctcaacgtgatgggtaccccatgctcgtccgaaccaccaatcatcaacacttcctctcccttcaaacgaaggtaacgggcataaatatcagcaggcacatacaccccggccaagtggccgatatgcaccggtccgttcgcatacggcaacgccgtagtaatcagcgttctcttaaaatgtttttccataccttgtgttctctttttgaggggcaaaggtacggaataatttggttagacgaaaaagaataatttcctttgtgagtgagtttcctcttaatgaggctaggaactttacctctaataataatatatatgggaagaagacataaaaacaaggtataaaaaaagagcttaccgctaggggacataaggcggaagctcttggcatcatcgaaaaaggtaatttcttcgacaaaaagaagattattataataaagatcgaagataagatttacacagcgtccattactacttccgagaaggggactttaatctcgtttatttaaatccaaacctatacaccagcgccaaccggaaattaagcatgaaatgggtcgctgagaaattctctgtagtctcgctcacttgcgtttcataatcccgcatataggtggaagcgtcaaatatcatccgtgaaccaaagccaagccccgcctcaaaagcgaaatttccggagataggttgcgaataattcaacatcactccgataccaaagaactgcccggtctgtccatgccctagcggatcattatcacgcacgttgaagttaccatatttcaattgcaagcctacattgaatccccgataagtaccatcatcgttaaaccataagcgaggctccaaggataatgccgacactccccataaattattagggttccctttatagccaaacctcgaatacgtaccccctagaataacagacccccaacctccaaacatatactccaattccaagtttggcatgatcgatccagtcttcagttccgctccattctttccaacactcaaacccggagagaccgtaaaccaaggaagtaagttagtcctaacagtcaagtttgtcatctggaaagtaggatagactttcggcaccaaacgagtcgcctcttgtcgaggctggtacccagtagactgccgttccgagacttgcggctcaggcgttacggacactgttgcctgccgagcaatctcaggctctgtacgagccggttgagagactaccggtgctttaaccttctcttgtacgggaggagctacgggaatcattgccccttcctcatagggaagatcggccttaccatcaatgacaacataagcgaagacctcatcatccacgcaaagatccggatcgttgagcacataaatataaggaacttccgcatatcttttcaggcttgacgagatagcgggtatagactgatccgtggaataaaagatctgtttattagcgaactctggcatagcgaaataaagcaggtacacatgtacgctattcccccactccccactacggtctacataaaaagagatctgtttattatcaagctcatatttgtttttcagatatttccttacggtgtttcctctccacatagcagtattcacggcgtttttggatactgcccctgtctctgtatagatatgcgagacgatcaacacgtgaaactccccgtccatcaaaggattcatcaccggccagattttccggttcagtcgctccatctctatggaattattcccgtatgtagcttggatatcagcctctccgggtataaaggaaaacaagaatgaatcgcccttggatttctcattctccgactgcccatgagccataaagattgagagaaaagaaaaacaaaatagaataatcaacgaatgtctcatgtcttgtcctttacataatgattaataacgcaaaaatagtaaaaataacaatctactatatagcacactctcatgaaacgtgcaaaactttgaatcaacagttacaagcacgaaatagagcaaatctcttatttataaggatcgacaggaacttcagttggttgattcgccacttccccattcacttcaattgctatagaaagagaacccttatccgaatttagcgagaaattgacattatatttatttttagctcctacattttctccagtcagaatattagccttagccctaaatagatttcccggatcgtttgtcagatagccttccaacacgattttggcatccgttgaattcggagcggcataaagcgttcctgttttcaagttaccactttccaataacgaaacacctgaggtcaacgaagaattatcatctatagctcctgtgattactaccatgttcgtgatagtgacattcttcttcaattcttcgagagaagcagcatcgattactacaatagaatttgaaagcgaacactttatcgtttctgtagttaggttacttccagagacagtagcgtttaccgtaccataaaagcaaggggaatcccatgcaaaagcggcatcacccatggttccgtatgtagcagtcagcttatagactccggtagcaacagtagcactctttcctttaacagtactgtattttccggttaattccgcaattgttgtttctcccttagttacagtcacatcaaaatcatcaatttcactttctgatagagaaactttgctaccatcaaatgtaccagcctttgttactacatttatggaattgtcttgttccaaggataggctcagcactcctgtatcagaatttgctgttttaatttcgccttccaagatattattacaggaggttagacctccaaatacaagggccgctaggcctagtaataaactctttttcatattggattggattttatttttattttattttattattcatatttcaaactaaattgataacaaactaatccaaagtctattgtgccaatagaccatgacggtttagaaccctttgtataaatacaaacacaaggtaaagaggaattcaaacttatggattctgtgatatcttttgttggattcgatacaggaagtaagtttgatgccgatatagaagttgcattacctgaagtaataggagagcctgcagattctgacataataacagaagcggtatatttaccaggtattgatcctccatacgcataggcctgcagataaacagaaactccgacattttcaggcatatgaaatttaggtgttattgcatatgcagatgttactttcaaaataagatatcctcctccactgctattattattcaatatccaacttgcgggattaacattatccttaaaactaatattatatggcaaccccgtaacatggcactctgcaggagaagaagctactgtttcaccatcaaaggtgactatagcagtcaaaacatgtttttgccaagcaaggtctgttaatatcccaacagtaccatatggaagttcacccgaatcccctccaccatccgttgtataagttacctttagaatatttgaatagtttgcgttattcaatatatccgaagatatatttactgttgcagcagcaataatactagatccgtccatttcatttgcagcggaagctccggatgatttataaaccgaataactggtttttccagaaactgttgccgtaaatgtcggcataggaatcgtttccatggtagtagatggaagatccattttatcacccgccttcaaaaggatagacgcagataatgtactaccttgaggtacatacggccacccttccaagacattcatcgttgcgttatcgggattgttcgaatacgtccggattgtttctccattgtataagacctttatatcccatgacgcgatcgcttctaccggagcaccattagccgaaagattcaatataacgtctgttccagtcaaagaaccattgttataattatgagttgcttttgctgtcaattgaatgtttgagaatatagacaaatccggattacattgaatggtatattgcgtacaagaaactgtttcagaaatcacagtccattccgtcgaggtttccttctctgccagattcttgccattgaatatgcctgtcactgattgtccggcttttacatacaaatggttatttgagttttctttcgaagccaattgcattgattcttcacccacttttagcgtcaacgcccaagtggaataatgtttttgtaggctctcatccacggcagggatcaataaagtgttagctaaagcggtttcaatagaagctgaaacctgttggttaggcagaaccgtaacgattgaggaaccccaaaaatagggctttgtttgaatcaaagcattctcgccacaataagcagaaaccatataatcaccggtttccaaaaccaaagagctactacctaattcactaaactttttcgggaaaccgtcaacgctagttccccctttttggatatctatcgtaaaatcggaagcatccggtacatcttcgctaggtatagatgtcgttgacgctttcgtctgcgaagaagacgaaagctctgtagttacagaggctagttccaaacgtaggtaaccttgtccttcggcaatgggattacgcagatcttccgtcacgcaagcgctcagcccgagtaataaccctagcaaaccaacgtaatatctccatgttctccaaaacatccggttctctatattaatctttattcaacacttcacaatccaagcttttcgtagccatcgagtagacgatctcgtagatcgtacccgctcgaagatttgtggcggtttctttcttctctagttcttctccatccttatttgtcgctcttaatgtaaacgacaaagaacttcctaccgccgaatcagagaaatagcctatctccgtaggtttgagcgtaatcgtacgatcaccgatagtggcatctaacgtataattttcaaaactagcgggaagatcgtccttcaaacatataccgaagtttatcatcggtacggatacagcagggtaagttaccttctccgcctctatcacaaatgactgttccttataatatatggcttctcctaaacttccctccgcaaaaacagttccctgcgaagtatagttagaggtatatgccttcaattgatatgaacccgcaggcaattctatcttacttggagtttgtcccggctcatatttacaattgttataaagagcaccctctttccagatctctatcacaaaccgagcatcaatcccggctttcgtttggatagaattgacatcgctagtagccacagtcacgttatccaaggagaggaaaccgggggattggggctggactaagtcctcttgttgacaagaaacaaggattaaaagaattattagtgtatatattattcgtttcatcttgtcattttctatttatcataaatcaatgatatattatcaatggtaagacagctaccaccataaattttacggcttcctgctggtattgttattgtttgttttcttacagcaggatcttccccttctgccactgaataacatctaatacgtatagaagtcgctggtttcaagtcgctttcatcatacggaagcaacactgaagccaaggtatatgaagaaacagtctgtctcccagatatgtaagaatttgaagctatcacatcatctccattcatcaattctacatacactccaaaacgttcattattataactatcatatttgtaataaaagtccaactcagttggacgagaaccaaaactgtagccctctgttatatttccactatcatctgtattcccaacgatcaacttacctcgatacgcggtaccagacataacttcagaggcccatccattattagcagcaacagttcgtataacagcagcacgccctttatatccatcttctgtataagtagtagtaggaaatgttttataattaggataagtactatatttatccctcatcgtctcattgttattagtatcccaacaatgctctacatgttcactccaaggttggtaatacggttgttcatatctagtggaagaagtccactcctccatgtccgaattaggtaattgtattggagattctaattctacattgatagcagaagatgccaactctcctcgatacagcgcccgcacttgataaatcttattttccggtgtagaaataaacgcttggcgtgcattcgtattgtcattaaacgcattccaagttcgcccattatccgcactatattgataaatcaaatccgcattgatggcggtagcgtctcctttcccttctgtaaccgtacaatcctcagccgtaaattccttcgtccatacattacccggcaatacacttacggaaaattccggtttatgagtcaatatcttatattccccggagattgtccggttattagccttgacctctgtaatggaaaaagtattatttatcgtctgctcattatctgctttcaatttagagaccaactccgcaatattaattgaaggactactctgtccaatcacaggcaatatgattcctgcatccacgaatttcgctttatccgcatcgctcatcgttgataaggtataatccccattcaatgccttataaacttgatcctcaaagtccaccgcaaatttcaactcttgtaaactggaagatagatcgaaatcgaatgatacatcttttggactagctgtttcatacagatccagcgtattccctgtaaatccctttactaaaatcttaggtgccggtaaccactccatcggaatcgtcgcattaattgtctccttcttcacctcggcggcagctaccgtaaggattacaccagaggtagttttctcgacagataaattaataacacaatgcgcaccagccacgaatgtctccgctttactgaactcactatgcgtcagctccttggtgacatcttggccatttcctttcaacttgcctttaaaaaaaaacttcacatccgaacctgcccgatagtaagcacttcgtaaagtatcttgtaaggacacagaactattgccaacctttacttccacgctatagctcgagaacagagcctcgaatttgtccttattattcccaaaacggatagatgccagcgcattcgcaacatgacaaggaatcgttaccgaaaccgttttgtccaccgtcaaggtagcctcctccgttccctcgtagtaaggagcatctaaagcaagtactggattctcttcatacgatgtgttcgggctacaagtagcctttaccgtataagttccaacagacgcaggaattgtctgatccgtgaaagcacccttataaagttcctttccggttgtcttattggttattagtagattgaacttctctgcgaccggcttatccaaatcagcgggtgtcgccttcgtttccacctcggcagtagcctcggtcaaagatatactaaaagcacctttcaccgggtccgacaagttttcttgctgacaggcggtcaaagcgattgatgccagcagcatcgtatatatcttttttatcttcatatccttaatcatatatcaattcacactcatccaaccatagtttactacctacacctcccgtgaagtagtcaccatatttgctagacgaggccactatcacgatatatttgggtgtacggttcgtataacgataattcaaaacaatatcctcttgcgtgtacgatgttacggattctcccttggtcaactcgccataggcaatcacatgcgaatcgttgggatcgaacaattgacgctcggatggacgggttcgtatctccaatggagcatcccaatctgtcaacgcaatataaatctgacaagagtccgggcggcccttcaaactcgccatcgcatcatcaccaaccttatcgattgttgcacaattatatttatagtgaactcgcaacttactcgggaaagaagtaaaaggacggccaaaatccaagaccccatttgttccatccgtcttcttatacgtacccgtaaagatattgccagcggcgaattttatcacgatatatttagactccaaagaagctgcttttccagagccattacttgtatccgtaaccggagttgagttgctttcaccaactgttgtcgccccttggtttcctgtatcccaaaaagaactttcgccatcgccccaaggttgccacaacttattgtttttatcattctgcgaccaattatcgaagctagcattcgtcaatgggatctcttccgcagtcgtaaaggatttctcttcacccgccgtaccatcaatcgatacccgatattgataagttgttttcgctttcaagccagtgacagtagccgtaaaggaagtaccggaaacctttatcgccgaggttgccaatgtattccaagcggcatcaccttgttttttatactcaatgaccggggtctttccactctgtatctttccacttaacgaagccttggtcaccatagcgaaagcctccgaggaagttgacgattcccctgatttatgatacacataaaccgtccatttctgcatcacgtcttcccatgcgtttccaacaaagaattgtcgggaaccacttgaataatctttctcggtagaagcggttggatccggctctaccgtaccatattcaccaccaagattcatcttattcacttgtaaatcccttaaagattgttccggagatacataaataatcacgttccggttgtacgcatcgatgactgcgtttcccacttgattggtcacatcaatttcccgattgatgatttgctttacagtcaccttccatttataatcttgatacgtacttatcgtaaaagaaaccggtgacgtgaaatctactcgtgtattagcggtagaagagatgctatccaacgaggcaaagcctgtcgtagggaaattcttaatatccacacaagccgtagaatcacccactaacaccgctccatccgttattttcaagcgcttaatctttaagttagagatatccacggaatcattcacaaataaagttaccgtacgatctgtattattgatcgtagcctcggcactttgtccgtcctctccagcccgttgcccctctacctccatggaaaggatcgctccatccactacaggataaggaatatcatcctctataacacagctggccaacgtgaagaataagcttatataacaacctaattttatcatcatctcctaatatttacagataaaacgtcatacctatatttatagagaatagatttatcttaaaattacccgaagaaacccgttgccgtccttcctccacttggtttgtctcttgatcaatccacttaaagtcaaaacccatcacgccaaccgaaacctctacagcagaccaatccgtaataaaggctgtcattcccggtgcgaaaccaatctgcatattctgcacggtttgataagagccatcatattccgtacccgatccggtagagtttttacctgttccatatccataagtcaaccgagcctcattaaacaacccaaaaatcttactttttccgatcggcatataggtccgtataaagcaagaagcctcatacttatgctccagataatacagatccttcaagctgattttaaagtcttctcccaaattcaaatcgaaattacccagatccaaataattccgtttgtaagagaagcgggcacccatagaaatattatcccggaaaaaataaccgaaataagggcttacgctaaaatcgtaacctttcccctctatatctttaagtaccaagaagttcaaattactctcattatgttccgagtaagatatcgtaccaccagccatccatgttcctttaggaataaagactgtcttctgtatctcgcgatcgatacgttgaatccgttgagcctgcgccacaccggtgttactcagcaaccaaagaaccactccccacaggggaactatcaaaaacttatgcatcatttactttctattttaactctaatatttccagacggatctctccgggaaagtcggacagcttatttgctgtccgacaccgcaaatgtactatttttctgctcatggtctaacagggaatctcaaaacgtcatcgggagtatttctgtaggagcagaaaaacttcctgatgatgttttaagaatatccaagcccttaggaaaggcagggttattcattgatatagtttgtatctatcgtaggctcgccgtattccagatcgaactcatctaacaataaaacactggacgtacttcccgtaaaataatcaccgtacttactagaactacataccaccaagatataagtaggcttcttcgtcaaatcacgatatttcaaatcgatcgaaaaagattcatacgtatccatcttcttcggagatgtcttctctaccggaagctcgccataagcgatcacgccctcggtagtcgctggattaaagaacttatcatcccctgtacttacggcaaacgcactcgtccaatccagtaatgcgatatagatggaacaaaggtctctatcccctagttttacagcagtaaccctatctgtttttatcttgtcaatattccccggattgtatttataatagccggtcaatttagtaggtcgctcggtaaaaggcacgccaaaatccaatttcgctcctaaaggagaaagagtcgcattcccaaaagcccccgtaaacaaacttccagcggcaaattggccagcagccgtcgtagaccaaagcttagcggctttaccacttctcacatctgtttcctctggacaggtcgggtttatttctttaagcgtattcgcccccttgtttccgctatcccaaattttcgtcgaaacagaagttgctgcgtaataatgcttaccatctttcacccaattctcgaaattccaattgaatttatcaccacctttcaattgtgtttcggtcgtaaatgccagtccctcctcactactcgtatattccccgtcattgtacatcaaccgatagacataccctgtagcaggaatcaaaccaggcaaggtcgctttataagacgactctgcaccatcagcactggcggcaacaaggaccgcattgacagatgtccatgcactcgcatccttctgcttgtactggaatttcatctttccggtatcgaagcctgtaccgtccgcagaaagagccgtacccttcacatacgcaaaattgctccatgcgttggcagtttctaccgacaggcttgtcttcggatgacggtaaaccgggaattcaatcgtatattgccgcatctcatcatcggccgtgatcgtcacgccccccaacgaaccggttccttttatcttgaaattaatgatataatggtcgcgcgcctgcacttcccgatctttcggcttaattgtccatgtatcttgatggaacgtaccattatgattcatcactgccaatgaggtagttaaactcccaactgggaaataagcagacttcgacactgtacccatcttaaactcctgatccttgaccccttccaacgcactcttcactaacgctgtagcagaagagaaagaggcgacaaaatcgggatcgaaattaacagtcacttttacgttcgccaacgtacacttcacctctacgggcgtactcacgtccttcgtaacagtcgctttcgcagaaccgtaataataagggatatcgaaccccgactccaagccatcaaaaccatccgaagccgcagaaaccgtatatgtcccaaccggaagcacgatcggctccaacaccttggaagaagcaaccgacacatcctccagcgtcttcaccaccacattcttggaattggtgatctttatcttgaaacgcttcggatcgtaattctccggtaccgctttggtagaaacgtccgtagtagacgagacgttattgatctccaagcgtaaatagccgctgcccgtatcagaggaaacgttttcttccacttggcaagtgaccaagaacaaagcgaatacaaacgacaatatcttgctacaatctatatctctcatgatacgatccccctatttcttgattttcactttcaactctgcagaagcagacttgccattttgatcggtcaccgtgattaggaaaacatgctcttcctttccatccggctcatcgtcttcttgatccgcatctaccgtcggtccgtaaatattcatcatcgcaaaaaagctgccgatcgggaaatcgtatgaggtcacacctttcgcaggcatagggatattcacgcccacagcagccaaaataccacccaattcatcgtcaccgaccaattccctgttctcgaatccaagatccacaaccgcaccaccaaaaccaccattccccgcaatgatagtggccgttagactttttaattttccaggagtggaaactttcacattcaaattatcgggccaatcttgttcactcagcgaatactccacacctgtagcaaacgcgtcgcaaatcaattcgggaagccccgcatccggatcaaccggcacctccggttcctcttcctcctcgcccggatatacgacatcaatcgcctcctcgtccgtatggttcgtaaacaagatattcgcagccacacccaaggatacggaaccgttctccacctctgtcaacttcaacgtgattttcaaagcttcaccgccttcgaagaactccgatacatcatcatatttctcggtagcttgcgactttgtcagcgtcatgttctccgtaatcgtattgccaccctccaacagttttcctctaatattcaaagaaagcttatccacctcctctccgaaaaaccaatagacaagccgtttcgttgtcgtgcttgagaaatcgagaactgttccggagccgtcatcgatcgtcagtttccattcagaaagagccgcagagaactccggatccaaaacgatctcgatcttcgtgttctttatcttgcagtctaccacgctttgggttttcacttgcgtggcgatcgccacctcttctgctccctcaaaataaggcaccgacatctctttctccagcgtcaagttcgaatgggcagacaccgtgtatttaccgacaggtaagagaagtccctcctccgggaaatcggaaggtgagggataagagtgagactcatcggcattcgcttcctccgctccccggatctctatcggaaaatcatccgtagcgacagccgctttcgtcgagaccggattttcagccttcacgtccacctgcaacatacccttctccgtattcgtcttattcgtccccttgatctcctcccgcatctcgcaagaggtcaatccgcacataagccctatagcaattgttatataaccgtatattttcatcatattcgtatcttccttattacatgattaatctttcgcccaatcggaaggaactgttatctcgacaggaatattttccgtgccgtcatcgaccgtgatcgtcaagccaagatttccttcagaaaggttattgttcgcctttacatttagcgtccaggccttattcgggctaatgacataactccattcccccgagtttgactttccatcggtaagacgcgtcacatggaaggtagcttttacagtctcatccttacccaccttcaaataccaaggagccgtatcattcttcgcccaagtcaccgtattgtttcccaacgcagcagtcgaataaataacataataatcactgaagtaggtcttcatgttctcgtcaaaattcacgacaaacttggcgcaagtaggctcacacgttaaagagacctttttctcattctcatccaagaccgagacataatcagaccctaccgaataaaagacatcacgcgaagagactttttcctcacccatatacgccttcaagaaataagaacctctccctagctcaatgctagaggctgtcagctccttagctaaaccagacttcacgatgcttccactctcatcatctttccgtatctccaccgtataatctcccaccttcgtataggcagcctcatccaccgccttcgtcttggaactggaagcgaatcccggctgcgcattcagttcgagcgtgatcgtccccgtccctttcgccacaggtactccacccaactcctcctgttggcaagagaccaacgacaggcatccgcccagcaggcaggccatcccccaactcgtaaacttcatctttctcatatcaatactttaaatactattcactcctataagaataaggatattcaaacccaaattcaactgcaaaagaacaacatcccaacaacacgtacaaggtctgtttatatgattacctattcttttttttagatttcgcttctcactaccacacatacagaagtgtttaagagaatcactatgtccgatttttgcaagccgatgttctcttttacaaatagcacaaagcgacaagccatcgcccccaacgtggaagaaagatcgttgcaaaatgacaatttgtaatcttaactcccgaagaatcgattattccgggcaaaagtacgtgtcgctcccaaattttcaagaaaaaaaccgcaatccactgcttaacagccctataacccaaaacggccttttattctagcgaaaacaattcatgctaattcatattcgaagcgtaaaaaagggagatccgggggcaagaatcgggttataccagtatacgaatgaccattcacgactactcacgatccagttctcggctacttacaatgcccaacggcagtatcggcgttgcccaacgacacctatcgtgcgtactttcgccgcctaaaaggtatccaaaacacggttttctcacaaaaaaggccgattattacctgtgtactcccgctatttttggaagcctagaaaacagtcttgtcacgatatacggaaccttttgatcaaaacgtcacaaaagaaagaattccgataacaaatgtgctttccggcaaaagtggagctcaatcctaccaagtacaagaaatattctgcgaaaagacacgacaagtctttgaaaatatctacttttgccaagtattcatgcttaaggaatgataagagagacatggaaaaagacatccctaaaatagacctgccccaagattgggtcatcgggaagctcacggccggagatattggattgctgaatctctacgccaattatccctgccggctgaaagcggggatcttcgtgctctgtctgggaggagaggtggaggcttctatcaacttgacgcagttcaaggtagaaccaggaagttttatcacgatcttaccgggtagcattttccagattcataaggtagatggagatctgcaaatctatttcatgggattctcgtccgatttccttagtaaggcaagcgcaagtaaatcgggtatagatatgcactatatcgtgaaagaaaatccgatctatcaaccgaaagaaaaagcactaccgctgttgaaagattattttgagttgttgatcaagacgtacgatatttgtggctcccaattgaacaggaatgttatcaatcatctgtttggcggtatattaatgggggttagctccatgtataaagatcaaatgacagataaggcaaatctctctaaagcagagcaaatcagcaagaacttcactcaattagtcatgcaaaactataccatgcaacgatccgttgcatggtatgccaagcggcttggcatcacacaagcgcatctaagcagcattatcaaacaaactaccggaaaaacttgcatagagatcataacctccatggtaatcatggacgctaaagctcaactgaaatcgacgaacctttccatccacgacatagcctatacgctaaatttcacgaatatgtctttttttggaaagtatttcaagcggtatgtgggcatgagcccacaggagtatagaaatagttagtcgatactcacatcccccaattctccctatccaaactcctatactgtatcgcctccgccaaatgccggacttcgatatgttccgaattatccaagtcggctatcgtgcgggagactttcaggatacggtcataggcacgggcggagaggcagagacgttgcatggcggttttgaggatggagaggccggaagcgtcgggaacggcgtactgatggagtagcttggagttcatctgggcattacaataaacaccctcataagcggcaaaacgcctttcctggatcgcacgggcttttatgacccgctcacggatagcgatactaggctctgagggctgttgctcggaaatcttctcgaaagggacagggacaatctctatctggatatcgatacggtccaataaagggccggaaatgcggttcatatatttctggacggctccgggagaacagaggcaaggacggtccggatggttgtagtagccgcagggacaaggattcatggaggccacaagcataaagccggccggatattccaccgtgaaacgggcacgggagatattgatcactcgatcttccaatggctgccgcatgacttccaagacactcctgttaaattccggcaactcatccaaaaaaaggacaccattatgagccaagctgatctctcccggctgcgggaaagtgccccctcctaccatggcaacattagagatcgtatgatggggagagcgaaaaggacgttgtaccatcaaggagacgccacctcctatcttaccggctacggaatggattttagttgtttccaaggactcatgcaaggtaaagggaggcaagaccgtagggagacgtttcgccaacatggacttgccacttccgggaggacctaccatgatcagattatgtccgccggcggcggccacctccatcgcacgcttcacgttctcttgtccccggacatcggagaaatcgcaatcaaacaattgctggcggtcgtaaaactccttacgggtatcaataaccgtaggccgcaatgtaggtttaccctccataaactccagcacctctttgatattcgaagctccatacacttccagatcgttcaccaccgcagcctcacaagcgttttgcttgggtaagataaagcccttaaagccttcttccctagccttgatagcaataggcaatgccccttttatcggttggaggctcccgtccatagaaagctcgcccatcaatacgaatttggataagttggatgaatctatctgctctgccgccgccagaataccgatcgccaaaggcagatcataagaggacccttccttacggatatctgcgggggccatattaataacgatacgattgcgggggaatttataaccacatacttgaagagccgagataatgcgttcatggctctcacgaacggccacgtccggaagaccgactaaaaagaattggatacctttggaacagttcacttctacggtaacgaccgtagcggaaatcccctgcacggcagcggcataagattttactaacatagttaagaattttgagttactaattacaaattaaaaccggaacctcctgttttcaatcgctcagtcttcgaacaagttctccagtgtttgcttgatctcgattccattctctgttttcatcaagatcttatgatcctcatctatcaagaaacagcgtggcaatacgcttacgttatacagatctatcaacatagccgcttgtccggccgaatctgttaccagattccacgctatactatccttcttcagtacatcccggacattatccggattatcgtccaagctaaccaaaagaatatccaactgatctttcggatatttcatcgctaccttatccagatatagatcctctgtctggcacatatcacaccaaggagcggtaaacgtcagcaataaatatttctgcgggaaagagtccaaacttaccgtattcccataaatattccttacggagaaatctggggcttccgcacccaaagccgtacgtttcgcacgggcgctatattgctccagctccttcaccagataaaagtctttcaaccttggattcaataacgccaacaactcatcaattttacgagtatcatcgggatctgagaaaaaagattgaatcaagacaacggatgcctcttcattcgggttctctttcacgtaccggatcgcttcctcgctcaattgcatattaacattcgccaaacgagcggcgatatccgtctcctcgatcgtatcgttcaaatccttgctatttaaagaatttgataaatttgtcaattccgtcaataaaggagcgatttttttcttaaaagcggtcaacttatcatttgtccgtcccccctttacctgcaatagcaatggagagttagcgtcgcccgtgattttcacggtttctcccggttccagataagccgtaacccaatgctctttatccgcaaagaagatagtcacacaatggaaacccgcttcatgttgatcgatctggaactgcccgggtttcgtacaagccactgtatcaaccactttataattatccttctcaaatacagcatatacggtttgatcttccagattagaaagttccccttcaatccgatagacataatccttgccacaagatgacaaacaaattataaagccaataataagtgccagtttttttatcattactcctttttaagctcttcttataacagataatccggtctaaaggtaggaatattttttaaaactacttcacatttataataaaattaacgcagttatcataaaaaaagcgcagaattagtaattccacgcttttttataaagatatttttaaaccttgaccttttttgatcaagtttttttaagcaattataactgaggaccagcagcaaccaatgccttaccagcttcgttgcccgtgaacttagcgaagttcttctggaagcgagcagccaaatccttcgctttctcatcccattgagcaggatcagcataggtatcgcgaggatctaagatcttcggatctacgcccggtaatgcagtcggaacctcgaagtcgaaatacgggatcttctttgtcggagcctcgttgatagaaccatcaaggatagcgtcgatgatacctcttgtatctttgatagagatacgtttgccgctaccgttccaacctgtgttcaccaagtaagccttagcgccagtcatttccatcttcttaaccaactcttcgccgtattttgtcgggtgcaatgacaagaaagcagcaccgaaacaagcggagaatgtaggagtcggttccgtgataccacgctctgtacctgctaatttagcggtaaatccagacaagaagtagtattgagtttgctccggagtcaagatagatactggaggcaatacaccgaatgcgtcagcagacaagaagataacttgttttgcgtgcgggcctttagaaaccggcttaacgatgttctcgatgtgatagatcggataagaaacacgagtgttctctgtaactgacttatcagcgaaatcgatcttaccatcagcggcaactgttacgttctcaagaagagcgtcacgtttgatagcgttgtagatatccggctcgctctctttatccaagttgataaccttagcgtagcaaccaccctcgtagttgaatacaccttcgttatcccatccgtgctcatcgtcaccgatcaacaaacgtttcgggtccgtagacaaagtagtcttaccagtaccagacaaaccgaagaagatagctgagctcttgccctctttatccgtgttagcggagcagtgcatagaagcgataccacgcaacgggttcaagtagttcatgatagagaagatacccttcttcatctcaccaccgtaccaagtattcaagataacttgctctttagtcttcaagttgaaaacagtagcagtctcagagttcaagcctaattctttgtagttgtcaactttagccttagctgcgttgaaagaaacgaaatcaggttcgccgtagttagccaattcctcagctgtcggacggatgaacatattagttacgaagtgagcttgccaagcaacctccatgatgaaacgtactttcaaacgagtagcctcgttagcgccacagaatgtatcgacaacgaacaaacgtttgccagacaattcttttacggctttagccttcaagtctgcccaagcagcctcagaacaaggcttgttatcattcttatattcatcagaagtccaccacacagaatcttcgctggcttcattctttacgaaaaatttatctttaggagaacgacctgtataaataccagtcatcacgtttacagcacctagctcagttacctggcctttctcgaagccttccaaactcggtttagtttcttctgcgaacagaacatcataagacggattgtgaacgatttctttcacatcaacaattccgtacttgcttaaatctaaattagccatcttgaatttaatttaaatgattgactttatataacttttctctctactctagttcgatacggtgaggctttccgaccttttggagcttgctgcgactccaccttgttaaccgcggtacaaaagtaatatttttttttatcgtacacagcttattaaggaaatttttcagtaataattactcttttccatgcaattaacaaaacccttagtctatttgtaatatggagtttacaaatcatatacttttagctagcatctcaactatttccgaagtcgtcatcataggtattcgcttttattgtgactgaaacaaagatatatacttttttccacacaaacaaatccagcgtataaatataagaaaggcgcaggataaatatcttgcgccttctcttatatccgatcagaaatatattactttacctcccaaatctcacctttcatcaaaaggtcgtgtaatttacgtgtaggattcttcgcttgtacctcctcgatttgctggtggacagcctcatcataggtcggtccctccacatctcgtattacgcctaacgcaattggcatatcaccgctcatcatggcaagcatcatatgcaaggtgttatccttctcatgggcgtcgtgtaccaatacgtcatccatcgtataaccatcttgtccgatcgttacggatttcagttttaggccgtctagcacaaggcctttatccatgttagcgccgtaaaccattttctcgccatggcgaaggaaaatcgtacgatccgcacggtatgccttatcaacgatccccttatggataccatcattaaagatcacgcagtttaccaacacttccgtaacggaagcgcctttatgacgggcggaagccgtcaatacctcggtcgtattcttcaaatccacgtcaatcgtacgggcgaagaaattaccacgggcacccaacgccaactcggccgggataaacggatcttccaccgtcccatacggagagctcttggatacgaaaccacggtcggatgtcggggagtactgtcccttcgtcaaaccatagatcttattgttgaaaagaacgatattcaagtcgatattacgacggacagcgtgaataaaatgattaccgccgatagccaagcagtcgccatcacccgtaatcaaccacacgctcaagtccgggcgagccgtctttacgccggtagcgatagccgctccacgaccatggatcgtatggaagccatacgtattcatataataaggtaagcgggaagaacagccgatacctgagataactgccatattgtgaggagccactcctacctcggccatagccttatgcaggcaattcagtaccgcatggtcgccacaacccgggcaccaacgtacgtactggtcgcttttataatctttcggttgaaatttagtttcttctgttgtcatcttttaagcctccaatattttagtgaattcctcaactaatctcgcaacgacaaaaggttgtccctttacacgattgaagcgatacgggttaaatccgggtacctttccacgtaaatagttagcgaactggccgttattttgctcagccaccaccactttcttatacttagaaagaacctcagccgtattcttaggcagcgggttgataaacttgaagtgagcgaaagccaccttcttgccattctcctgcatcgtctccatcgtctcgtaaaggtgtccgtaggttccaccccaaccaacgatcaataaatcagcgtcctcatctccgatcacttccagttcggggatatagtcggcgatcttatcgatcttagcctgacgggtcgtcaccatcttctggtggttagccggatcggtagagatagcgctcgtctcgtagtctttctccagaccgcccagacgatgagcgaaaccttccgttcccggaatcgcccaataacgaaccaagctttccttgttacgacgatacgccttccaaactttctcgtcttgataattagctacgtaattcggcttaatctccggatatttatccatttccggaattctccaagcggaagaaccattagcgataaaggcatcggtcaacaagataaccggagtcatatgctccacggccaacttactagcccagaaagcagcatcgaaacagtcggtcggcgtagaagcggcgactaccactacagggctctcaccgttacggccatacagcgcttgcatcaagtccgtttgctcgctcttcgtcggcatacccgtagaaggaccgccacgctgaacatcgataatcaccaaaggcaactcagcgattacagccaaaccgatcgcctcgctcttcaaggcaagacccggtccggaagtagacgtagccgccaagcaaccggcgaaactagctccgatagaagtacagataccggcgatctcatcctcggcctgaaccgtgataacgcctaaatccttacgtttagataattcatgtaaaatatcagtagccggagtgatcgggtaactacccaagaacaactgcaaaccagccttctcggcagcggctatcaaaccataggaagtagccttattaccattcacgtccgtatagaatccgggctcggctttcttactctcgatacgatacgtagaaaccgaggcatggatgttattaccataattataaccgtccgtcaaagccttgatattagcttgggcgataaccggtttcttagcgaacttattctgcaacatgtgcatagcctcctccagcggacgctcgaacaaccagcaaacaagtcctaaggcgaacatattcttacagcgaagagccgatttattgtccaagccaaactcaaccaatccgtcttttaccatcgtagagatcggagcggcaacaacctgcacgccagtcaatcccagctcagtaaacggatcatcggtcgtaaacaaggccttatccaaatcacttttcttgaaagagtccgtgtcgattaaaacaatcgcattgggttttaggtgttttacgttcacctttagcgcggcgggattcatggccaccaatacgtcggccttatcaccgggtgtgaagatcttgcgcgatcccaagtgcacttggaatccagatacaccacttagtgttccttgtggagcacgtacttctgccggatagtctgggaatgtagaaatctcgttcccgaaaaccgcggacaggtttgaaaagattgtaccggttaactgcataccatctcccgagtctcccgagaaacgaattacaaccttctccagcgtcttaacttttgtctgttctgccataatatactttattagctttatcgcttattggtatttagatcgtccgcaaagtaaagcataaactttgcgagttcaaaacttttccgcatcaaaaagcagagaggtatagatcaagattattagatgatagattaaaatgattagacacataactattcactgtcttcccgtaatacatatatactcccgccctaaagcccttatccgatttgatcattccttgcacggaaccggcgtcgcccaacgacaataataaaggcacgaatatattactataagccatcgaggtagtacgagccacccggttgctgatattcagtttacaataatgtaataccccatattgctcgaacaccgcaggatcttccctcgacaagcagcatgtcgtctcaaagcaaccgccttggcttaccctcagatcgatcaccaaagctccctttttcatcgtacgcaccaagtccgtagcgataatatagcgatgtctcgtattaatataacgcatcgccccgatcaccacgtcagcgctacgaaatgcgttatgcagcacattcggatggaacgtggaagtaaaaagcccttgtcccaagacctgttgtattatacgcaatttattgatatcatcatcgaatactttcacggatgctcccaaggccaatgcggcacgcgcggccacggtcccggcgtttccggccccgatgatcaccacttccgtaggggatacacccgggataccgcctaataagatccctttacctccttgggtattgctcaacaactcggaagcgatcgttatggaagccgccccctcgatctcggaagtgacattcagcaccgggaaacgattatattcatccgccatcaactcataagagatagcggtaatccgtttcgccatcatcaactcgaaagcctcctgagcgaataaattaaactgcaccaatgagaaaacggtcgtgcgaggtctcataagcgcgatttccaccggcaacggaggcaatatcttcaagatcagatccgcttggaaaacttccgcgggcgtatcgacgatctccgcccccgcctccgagaaatgattatcggaatagttgatgcctaatccggcgccactttccaccagcacccggtgaccgcaatcggtcagcatatccaccgcctccggagtcaacggcaaacgtttttccgcctcgcatcgttcacgaggaataccgataagcaaacggttattcaccttgctgatctctttcaataattcctgcgggatataggccccctgtgcctgccggccgtcgttcgcttccatatgctataggattttcattaacgcgttcgatatgtcatgtacatcagattctgttaacatcttctcggcatcaaacgttatggacgccttcgtataaaacggattccttttctccagactctcggcgataaacgccctcagttcctccccggaacgtcctttcaacaccggacgggtatgtttgcacaactccagacgcttcgccagctcctcgactgacaccttcaagtaaaccgtcgtgccagaagcgttcataaactccatgttatcgaaaaaacaaggagcgcctcctcccgtggagatcagcacgtcctcaaactcagcgacctcgtgaagcatattccgttctatctctcggaaagcctcctcccctctctcggcgaatatctgcgaaacggccttatgataacgcccttcgatatagtaatcaagatctatgaacgaaagaccggcgagcttggcaagctcctttcccaccgttgtcttgcccgctcccatatatccgaccaaaaaaacacgtttcatacgttattataatagttttcgcaaatgtaaactttttccgggaactctatcttctttattcctaagaatcaataaaaaaatcataggccaatggcttttactgtctgggtcgcacgatccactactaataaagtatgacgagcaccggctattttctcgggatagaccatcgaatctgtaaagtcctgcaataattttccgttcttagggctgatctcccatagctccgaccgtttatcatcgacacgaagcgtaacaaacaaacgatcccctacaaacgctatcgactggggagacttttcaaatcccaatgccaccagatacggctcgaaacccacgttccctacccgaatgtccgcaggatcgaataaatagatcatatttttattctgagccgtcacatacaaaaagccatcactccgtgccgctaccgcataagtacccattgcctcttgcaaattcacgctacggctatatataggtacccgagcagcggaaccgggctgtacatcttgctccaagacaactaccagtttccgtttatcccggataaagacagccccttgactagccgtcacatcaaacgcatgaacggtctgataaccaccctcaccccaagtacccgtaccgatacaagtaatgaactcatacgtttccgcatcaaacacatccgtacggcttcccgtattcgtgacatatattttcccatacgagcgagtcacgccgtttggctcccccgcaaaggtctctttcttatctccgttcatccactcaaccatacttttcacatgacgcacattaccggaagatacatcaaagacctccaaactataatgtcccggagcgtcatttgctacatatagcgtattcccataaagatggaccgctttcggatgaaaagtttccacagtggcaccgggaatatccaagacagaaagtgtaaatgagagaggagaaccctcatcgccagccctatccgtctccatcggagcaagcccaagcccgccatctatggcatccaattccggatcatcgataatgtatttcgaggaggtatacacgtttttattctctaccagattcttattcctccgggtatgcaagaaacggcgggaataaaccggtaatttcttgctcacggaaagctgtgagtaaaccttcatacaaattgtagggaaaccgccttccgccggatagtacgtcatattcccactatgcccataccccaagcagtgcgccagctcatgatacggcacatcagtcccgttggcatcatccgcataatgggtaagatagacatattcacctaatccaaaggtatttcccccgcccaggccgacaacattcaccacacgcccataacacaatccgccatgattcaagatctttttcttcaatacatctatatccacgatttgctcgttatttatcagcttgccgcgccacttctccagttcctcatcaaaaagcgaggaagaaaacatcgcagccatattcaaggaaagggcaaccgcctcacgagccagatgtggcctgaagttaccccagtttgaaccggaatacttaccaaaccaaatattccactttggtttcacgttaatcattccttgatataccggatctccacattcaatccgcaaacttatattctcggccgccatatccggataggcttctatggtaacctcctcgccggaacgcgtataataaaccttcgcctgttccagaaaaggcaacttcattttaaactcctgaaaaggtaaaaccgtagtaaactccgcaaaccgtacctcgtcctcatagccttcaatcgtcgcccatacgatcacgttatgtatagccctgggtgaatagaaacgaagcatcagctcattctgctcggtaaccgacacctgcaaaggttcattcaccttgaattttcgctgcgacgaatcgaaaagaacctcgtccggttcctcatcctgaaggatataagaagtattcgacgaatcataatcctcctccgccatccgtattaaaccatatttactcgttcctccactattatccacatcatcttcatccgaacatccgagaacaagaaagcctcccattacaaacagaatgacacgaatgatcgtgtatctcaacatttcattcataaataatctcttaccagtttgggacgcaaaaatagtatttttatttaactcgcataaaagtcaccgtttttatgtaattttgtcccgtagacagatgtagattcgatgatgaaatttatagataagttcaatacaattatccataagccatttttcagcaaatatagtaccttaatggggctatgggcattgctgggggttatcgcatggattaccaagtatttccccgggaaatataataacttctcgatcttcaggcaatccttttggcatacgttgaatgagttaccgctctatgccgcctatccggaagaatacaacgatatttttcactacgggccggtatttagcttggtcatcgctccattcgccgttacaccgttatggttgggattgcttacttggtcggtggcacagagccttttcttattctgggcgatcaagatgctgccggggatcaagcgggaacgtatctttatctattggttctgcgcccacgagttgcttacctcgcttttcatgtcgcaattcaatatcagtatcgccgctatcattgtcctcgcttacgtattgatagagaaagagaaagacgtatgggccgctttcgtgatcatgttgggtacctttactaaattgtatgggatcacgggattggcgttcttctttttctctcgccataagatgaagttcagcctatcttgcgtaggatgggcggtcgtcatggtcgtagccccgatgatattgtccgggccggattatataatgtcccaatataccggttggttcgaggacttatccggaaaaaattcggagaacttattcgcgctcatgcagaacatttccttcttgggaatggttcgtaagatatcgggatcggtcagttactcggacatttatctgataatagggggattactattattcggcctgccttatctacgcatcagtcaatataaatatgaggctttccggaaaacgttattggcctcggtgttgatgtttgtcgtactgttcagcacgggtagcgagtccagtacctatatcatagcgtttatcggagtcgctatttggtatacggctgtaccgtggaaacgttcgacattggatattgtcttgatggtcttcgcctttattttgaccagcatgtctccgtccgatcttttcccgaaatacatacgagtgcattatgtatacccgtatgcgttaaaagcgttgccttgtatgctgatctggctaaagctgacatttgagatgtgtacgaggagttataatccggtaaaggcataaatggaatgaacgcacgagcagacatagatttggtattaccttgttacaacccgccttcgggctgggaggaacaagtagccacccatttccgcgaagtggagcgattattcagcccggtacgtttccacctttttattgtcagtgatggttcgagacggggatacgagccggagacgatcgaccgcctccggcaattgataccggatgtctgcgtcgtggactataagcctaaccggggaaaaggatatgccttgcgagaggcggtaaagcgatgtacctctccttgcattatttatacggactacgattttccttatacaaacgactcgttcggcaggatggtcgaggcgttgctaggaggagcggacgtagtcgtggctacccgcggcaaaagttatcaggataatctacctcctttccggcaaatgttatccaaactgtcccacatatgcaatacatgggtcttgcggatcaagatcaaggatacacaagggggcatgaagggattcagccaagcgggacaggagatattcctgacgacccgtatcaatagcttcctattcgatacggaatttatctataaggcaagtcgccggaaagagataaacttacagacaatcaatgcgaacatcaaagaaggactggcggtatccgatatgggattcaaggtcctgcggcgggaagcgttgaacttcttatccatcttatttcatagagattaattgacatacatgatattacttagttttgatatcgaggagtttgacgctccattggaacacggcgtggaattgccgttcgaggaacaaatgcgtacttccgtagaaggaacccggaagatactggcatgtctggcccgtcaccgggtaaaagcgactttcttttgcacggcgaacttcgcccttcacgcaaaggatttgatcttggacatccaaaagggtggacatgagatcgcttcgcatggtttttatcactcgtcgttcgagaccgccgatctacgcaagtccaaagaggcgttggaggaactgaccggacaaccggtgaacggtttccgtatggcccgcatgatgcccgtcgaagaagaagagatacataaggccggttacttatacaactcgtccttgaacccgacttgtattcccggccgttataaccatctgggacaaccccgcacctatttcatgaaagatggcgtattgcaactgcccgcctcggtgaccccgatcgtccgtttccccttattttggctggcttaccataaccttccggccaccttgtatcgtaagttagcgctttggacttggaaagaggacggttatttcctaacctatttccatccgtgggagttcacctccttaagtgatcggaaagagctaaagttaccgtttatcatgaccaaccattccggttgcggcatggaaagaaggctggatgccttgatccgtttcttcaaggataaaagagcgccgttcggtacctatacgcaattctcacaagaaatcttgagtaagagtcatggccaagaataagttttatgtcgtatggaaagggttgaacccgggaatctatgataactgggcggaatgcaaggcacaggtagacggacaagagggagccaaatataaatccttcgagaaccgggaggaagccgccaaagccttcgaggccggctatacccattacctaaagaccgcctcttccccgaaagccgttgcccgtctcgcgccggaagccccgatcggaaacccgatcaatgagagtcttgccgtagacgccgcctgtagcggtaatcccggggatatggagtacagaggcgtttataccgctaccgggcaagagatcttccatatcggcccgctgaaggagggcacgaacaatgtcggggaattcctcgccttagtacacggcctcgccttgctacagcaaaagggaagcgacctgccgatttattcggatagccgcaacgccatcagctgggtcaagaaaaagaaatgcaaaaccctattagcacgtaaaccgatcaacgaacctatcttcgacctcatcgagcgggccgagaaatggttgaacacccatacctataccacccagatcctcaaatgggaaacatccgtatggggggaaatcccggcggatttcggaaggaaatgaggtaaaggtaattaaaattatatcgtatatttgcccaatatatcgaattcaagcctatgaagatcgctttcgacgcaaaacggattacgcataacgctaccggactgggcaattatagccggttcgtagtgaatagtttgtccgcttctttcccggagcatacctatcaactctatacgccgggcaaaggcaaagaagcgttacggaaacggatcgaggagcgtccaagtgtctcattccattatccggaaggcaggttcgataaactatttccgtctttatggcgtacctccggtctaacggctacgcttcgaaaagagcacgtagatctgttccatggcttgagtaatgagattcctatgaatctaaaacagaacggaatcccagcggtcgtaacgatacatgacttgatcttcttgcgttacccgcagctttataaaccgatcgatcgttccatctatacctacaaattcaagcaagcttgtttacgatcggacaagatcatagcgatcagcaggcagacgatgcgagacatccgggacttcttccacattccggaaagcaagatcgaggttgtttaccaaggttgtgacccgatattcgggcaagcggttcaagaagacgtgaaatcgtccgtacgcgagaaatatcagataaacggaccttatatattatatgtagggagcatcgaggaacggaagaatttattgcttctggtaaaagccctgaaagagctgaaagaagatatctccgtgatcgctatcggtaagcatacgccttatacggatacggtagagacctatatccgggaaaacaacctgtccggtcgcatccgtatcttgacccatataccttttaacgaattagccgctttctatcagatggcgaccttatttgtctatccctcgtttttcgaaggattcggtatcccgatcttagaagcccaacttgccggtattccggtgatagcggctaccggttcttgtctggaagaggcgggcggatcgtccgctctatataccgatccgagaaatgagcaagagctgcgcggcttgatagagtccgtattgaacgagccgaagctggccgaatccatgcgttccggcggacgagagaatatacggcgattcatgcccgacgtattagcggctcatttcatgcgagtatacgagaatatctcacgatcttagcaaatccattttatccatacacaatgaatatacttttagtctataaagaagccgacatagcgacctacaaaatgctggaaggattgtccaagcttgaggacttcaacatctatatcgcttccccccaatcgtataccgacaaaaagatctatgggaattgtacacctttggatctgccggtcattacctcgaagttcaactggaacgttattcgtgccctgcgcgaaatcatcaagacttatcggatcgaccttatctactcaccgagtagttccggtttatcaaacgctctattcgcctccataggcacacgggcgaagaatatcgcataccgaggtacgcaggctaaattgaagcggttcgatccgacctattatctaggcatattaaatcccgccgtggagcatgtcgtatgcgagaccaaagatatcgaggaatatctctcccgattcatcgcacgaaaaagactaacaaccagcacaaagccatttgatatcgattggatcaaggaggcagtccgtacgcccaaacaagcagacgatattccggacgacgcctttcgttgcatctatatcggagcgacgaagaacaggccgttcaaaggcttaaccgatttgattcatgcgtttatcttattggatgatccacgggtacatcttacaatcgtgggagaatatggggaaaatgatttccaattagcccaacagtcgaaggtaagcgcacaaattcattttctgggacagcgttccgacgccatctcttttctggtcacgtcccagttgtttatacttccctcgcaccgggatgcctccccaagagtcgtgcgggaggctatggcttgttccgttccttgtatcgtaacagacataccgggagcaagagacttaatcatagacggagtcaccggattgttagtgccgccttcttctcctcaaaaaatggcggcgtctatccgctcgcttatcgataacccggagcgattggaagcgttcgccaaggcctcacgtgagcatatcatccaagatttcagcgtaaaggcttatacagatggcttcgccacgttattcaggtcgatcaagaaagcatagattatttacagattcagaaacaacggatataagctaatgaatagctatcataaagatggtccttcattccatgtttatattggaaggacaggatatttttcttaagctcataatttagctttgtccgtagaatcatcggcttatccccattatcccgatatccccggaaaccggcataattacaatccaacgagaacccccgataggtccctaacacacctgccccataacagaaagcgtcgttctgacgattaacgacatcgttagtcatccaacaataaaaacccactaaagcttgcacacggatcgaagcgtttacatctttccgcttccacaacgtacgtcccagattggcgtcgaaccaataagaggccgcatccgtataacgagcgtcgcacaagcgtccgccactggcggttttcaggttggcgcttaccacgatatccatccatttctcgctccggagggcttggaaataaaaattaaagatcacgtcgccccggcaaacaatcggggatttcagttctaccgcataacgctcatcccgcacttccggcgacatctcataccattcttggaatacccaactgacattcactcctacacgtccctttacgacaggaatgtacaaacgggtaaagatatctttcgtctgatcgcctcgcgtcttatgatattccccccgaagctccacttcccaacggctggacaggcttcctcctaccaactcgggaatcggaaaggcatttggcccgaaataacggggcgagtaagtcagatactctaccttttcccaccattctaacgccttaaccggagatacataggccaaaagacaactaacaactaaacagaaccggagtatttgtgttttcataaaagtctataattcaaattcaatctcatgcttcaacgcatatttcttccagaaacgatttcgatagtataatatccaacgaaggcattccgctttatcaaaatgccggctctcggcataggtctccgccattaaatgaaaagcggcttcccgtccccacaagcgggagaaattcgcgcatcctcgtttgagcgagacaggcccgaaatacatccggtttatatcgatcaaggagaacttaaccccttcctccgtacgatcgtacaatacatttcccggagagaaatcggcatgatagacctccgcctcatgcaactctgccatataagtacctaacgcacgaaaaatatcctcgttcccctctaccggacgctgtccgactttatacaatgtcttatatctagattgcagactgataaaataactatattccaaaaaccctttcttcctaaaaaggatataagcgatcggggcaggtgtctcaaatcccttggcaaccaatcgcagagcgtactcataggctcgcacagccttaggctgacggaaaaaacgataaataacacggtttatcaagaaggggactctatatcgcttgacattcagttccacaccatctacctcaaaaaccttgatctcattcctcgccttataaatcgtttttccctcttctgaaaatatacgaggtacacgccttacaaaatcctcgaatcgcccgtacgccgggttaatgacctccttcatccgaaaccgtttcatttaaagaggttaataccttgtttatgattagatccggattgagctgtttcatacacgcccaatccttccgcaggcagggcttttggccgaatacggaacaaggacgacaaggtaagtccaactggatacaatcttccggatcctgatgatatccgtaaaatccggcatagggatgggtagcgccccaaacggaaagcacccgtgtaccgaccaaggaagcgaaatgcatattggcggaatccatgcaaatcaacagatccaaccggctgatcaaggccagttcctgatccaaggaatacttgcccgccacgctttttacccggggatactcaaaagcccattgatccaagagcgcctcctcgtagccacgaccaccgaacaggaagatggtaaaatcctctcgatcggaaagctcggccatgaccagctccatctccccggtcggataaatctttccccggtgcttggcgaagggggcgataccgatccatttgcccgtcttcgttcccacaaggggttccaaggcggataaatcaggggtcgaggcctcataaagcgaggtgaacgattccgtataatgaagtccggcgttacggaaaacatccgcgtaacgttcgatcaccgggcgaagttgtttaaatcgtttatgcttcgcgtcggtcaaccgggcacgatctttccgggccttatccacgacaaacacccgtctgccgttcaagcggaacagcgtacggatgatcatggtccgcaatacgtcatgcaaatccaaaaccacgtcgaaatcatattttaccaaggcagaggcaaaacgaagcaatcccgccaacgttttctccgtgctcttcgtattgatgccgatcacgttcacgttcttcgggcggttgataaagaccgggatcaagaacgcttgcgtcaacacggtaaacgagtccgtaggattcgccttggcggcggaatagataacgggaacggtcatcgccacatccccaatagccgaaagtcgtattactaatatatttgccattatttcttaccgtacaacacaggattcaaggccgggtcgttgtacatcttcatttgcttgtagaccttcatgtatttcttaccgtcacggatatcggatagcaattgatccaaagccatcgacaaatccttcttctgctccatcagcaccgccagtttctgctcacaacgagccttatgctcggcagtagcatccggacggtttgcctcctcacgcatatgatagatctttagcgtaaggatagagagacgatcgatcgcccaagccgggctttccgtattgatcgtagcatccggcaagactttcacgttcttgtatttatccagaaagaaactatcgatcaactctaccaaatccgtacgatcttgattcgacttgtcgatgcggcgtttgatagccagcgcttccaccgggtcgatctccggattccggataatgtcctccaaatgccattgtacggcatcgatccagttcttaagataaagataaaactcgatgctctttaccgcatagggattatgcactgtagcatctacattgtcagttacatgataagcctccgtagcttgctcaaaaatgcggaaacattgttcgctgaagttcatatatgattcattttctttctgtgaatactttgtgggacaaagataatgcttacggatcagaaacccaattctaccggataaattctatcctcttagcatatatcctttcttcggcaaggatacgatgccggtagacggatcgttatgaagcgctttacggagataggtgacctgcacattcaaggccagggagttggcgtatgagctagttccccagacggtttccaacagaaggtcacgatccaccgccagattcaggtttgtcgccaggattcgcagaatatccgcttggcgggaagtgatcaataccttgttattgcccgtacggatctcattcgtggtatagttgaaggtcgtgtttccgaaatggaagctctcctcctgcacgttttcatggacaccgatctcaaaacggtccttgatacgggcgatcagctcttccggatagaagggtttcgccaagtaatcgtttccgcgcaagctaaaacctttcaaacggtcgttcttatcggaacggtcggaaaggaaaaagatcaagacatggcggtcttgctcacggatcttttccgctacctcgaaaccgtttaggccgggcatgttgatatccagcaagaccagatccggtttcacgaccgggaattgctccaaagccatggtaccattgccggtataagtcacctcatacccctcccgttccaagaatcgcttcaagacgagggaatacttaaggtcatcgtcagcgaaaagtattttcaatgtcgatttcataaggctgtagtcggtagatttatagtaattcgagtgccttcacctaattcacttcgcagggatacagagccatgatgcgcctctactatttggcgaacgtagctcaatcccaacccaatacccggaatttgcttatccggcagatgagacgaacggtaaaatttatcgaacacctttcgccgctcatccggagcgataccgaagccattatccgaaacggtcaattccaccctttgctgattccaaagcactacgatatcgatatccacttcctctcccgaatatttgatcgcgttctctatcaagttagacaagacattcgccacatgtaccggatcggccgtcagatccggcatatccgggggaaaggccgtcgagaaagagacttttttcccggcggggatattggttaggcgtaccaccttctccaccaactcacggagattaaaagcggaaggtctcagaagcgtctcccgctcgtccgcacagaccatatctttcaattttcccagataggcggaaagattatccaactcgaacatggagtcttgaaggacccgttccgtcgtggcctcatccatccgcatctcccggtcattcaagaaagagacgaataccttcaaggtttgtaccggtcgcctcagctcatggatcatcgtatgcacgaatccctcacgcaactcgttcaagcgcatttgctcccagatcgtacggatctggagacccaaacaagccagcaataacaagataaggaaaatacttaggaaaagctgccatcccatccggcccaataacggattcataggaagatccacatccacccacaccgcctttcgctcgatcggggcgaacacatagcatatcgagatagaggttgaaaacaggtttttcgataacggcaaccataaggccgatgactgtccggacaaggtatcgctcgctacgaacggacgtacccgataatccagaccgggcagactggcagacaagatggagtccaaacgctccgcggagaaaggcacaaagaactccacgaccgaacgatctaccccaaccaataagctatcttccggcatattcgggtccagatgaagccgaaaactatggatctttgtcgtatccttgggataaagctggaagccgaacgagtttttcaacccatttaacacgctatcaccagactggtatttcgactggcgttctatgatataagtacctttcgtcatctccgcctcttccttccgtatacgaaattcctcctgcccggcatgaaatacctcaccggcgatctcatccgcataagtacacatctcgtaccggaactgattgaacagccaatagccttgtaccccgatcgccgccaaagccgccgccaacgagattacccatatccatcgaatcctctttcccatatcttattcctttccggcaaagatagatagctactccatgattacaacgtacatgtagccatttttataagcggagtaatatttcagtaataaaaatcttccttacggcaaacgttcctctcttacattcgcgacaaataacttctaaaaccaacagatcatgaaacgaatcatagcgacaatcggcctgctttgcgtaggtctgtcaggggcgggacacgagacgaacgcccaagtgacaatcaacatcttcaacctaaacgacgtactaagagccaagcccatcgacgagacacgtttcacggtacaataccaaaccacgtccatgccggacacgctccaacccgacaagaaagaggaagagaccctcatgctgaaggtcggggataaatgctccgtttactatagttacgccaaattcctcaccgattccgtactagaggccgacaaagccgccggagcctcacaagaagtcatcaatgaacacctgcaacaatattcctccaagaccaatgcacaggtctacaagaactatccggcgggaaagaccacgaccttggatgcccttgccgccagtcgctttcgctgcgaggaaaaggaggagcgcccggaatggaccttactgcccgatacgatgaccatcctgtcctatccttgccggaaagcgacctgtcatttcaagggcagacattatgaggcttggtacacgccggagataccgaaaagcgagggtccttggaaattatgcggattaccgggcctgatcctaaaagcccaagacagccaaggacattacactttcatctgcacgggtatcgaactgagccggggtaagaacccgatccttttcgggggaaacgatttcgagccgatcagccgcaagaacctgcaaaaggcttacgaacgatatgccgccgatcctatcggatacatcgccttgacctcgccacaggtgaaagtgaccgtcaccgacgataacggaaaaccttaccaacccaagaacatgccgtataaccctatagaaagggaagaaagatgaaacggatcatactgcatatacacactttttgtttacttacgctgctctgcccggcaggattggccgcccaatccgtcatccgagggatcgtgatcgacagggaaagccaactgccggtagaagcggccaccgtgcaattaaccagaggcaacgcctcccttccgatcaactatacgttaagtaataatgaagggacctttatcctcacccaaccgaagcggacggactcacttctcgtctccgtctcgctcttggggtaccaaacccagcaacaagccgtacatgccggacaaacgcttcgttttgagatggagccgcaggtattcagcctaaaggaggtggaaatccgtccgggacgtgtctgggggcggcaagatacgatcaattatgatgtcacccgctttctctccccaaaggatcaatccatcaaggacgtattacggaaacttccgggtatcgatatcgatgatctggggaagatctcttacaacgggaaagagatccgtaatttctatgtggagggactggatctcaccaacgggaaatacaagcaaatcagcgagaacctgcgagccgatgccgtacagaacatacaagtgatggagaaccaccaaccgatccgtgtgttacagagaaagatcaagaccgaagacgtagcgttgaacctcaagctgagaccggaattccgggatcgctggttgatcaatgccgaaggcggtctcggcgcatccccgttcttatggaaaggagccgctgacgccttgcagatcagccgcagcagccaatccgcttatctatataaagggaataataccgggcaggatgtatcgggcgagcaaaatacgcttaccgaatcacccgaatcccgtttatccgagcccaaggttccccaatttctgctacagccctcattctccgccccgctaaagaaagagcgctggctgttcaaccatatacacagcctatccgcaaatcgcctatataaactgaacgagaacacccaactccgtataaacgccggttatatccacgacctgcgaacacaggaaagggggagtgagacgacttattaccaatccgaggacacgattcatctaacggagcaaagcgatagccgcattcgctcggatcaagccaacctcaatatcggagtggaaaacaactcgcaggaaaggtatctcaagaaccagttctcagccaccggagattggcaatccagcctttcccatataaccggaaacacaatttccaccggccgtacaacattggaccaacgcatcaaaaccccgaacctcaacttgcgtaataatttacggagcctgtggagcttggacaaatacacgttggaagtccagtctttgctccgttaccacagcaacgcggccgatcttcgcttggataaccacccttatccaatgagcttacgcgacttttataccgataattccttttcattcctgaaaaagagcggtcccctcacccagcgatatacggtgggcataaacggggagatcagcaatatcaagaaaagcctgcaaacttatctctcacccgattaccaatggaatacctataaatggaccctatccctcagctccccactcagatggaccggatatacaggggtcggtttctcccgcatctcggttaatccgtccctgtctattatctacaaactgaattacgcatggcgtttcacggtacacgcctcctataaggaaagatatggagagatgaccgacttatacgaccggccttatcaaacggattaccggaatagcgtctggaattgcggaatcctcccggtttacagacaacagctttattccgtttatggggaatacaagagtacggcacgggaattcttcgccacggtaaacctgacacacaaccgggagtggtacaatcgtatatacgagcaacgtatagagaacgggcaggtacaacgagtctccttaccgctgtccaaccacggttccggctataccgtcaaaagcacgctatccaaaggcttttacgatctagggctaaagacctcgctcatggcgctcctcaatatcagcaaggccgagcaaatcagcgggggacaaaggcttccttatcaatatcgcctcatgcgcctagagcccaaagtgatctggactcccaaccgccattgggaaaccagttaccaaaccgatatccggtacggaggaagtaaaataggagaacgtacccgtttggcgcccttatggaacgtcatccaacaagtacaactctcctacattttctcacccatagaggcaagtctttccgtagatcattaccacaatgacgtgaatgaagaccaatccgtcaacgccgttttcgcggacttctcggtctcatggaaatccgggcgttggcaaatcaccgccacggcgacaaacctgttcgacaaacgtacctacggatacacgcgatacgcatcgttggaaagctatacctcatgggtacgtatccgtccccgggagtttctggtagcgatccgctaccagttataaacgatccagacgagtccgggttataggcgtatcttccgctccaccgtaccctctgccgtatctatccgtatgaaataaacgccgggctggacatttcccaaggaaacagcgtaatccaccgaggctggagaatctaccttctcaccatacagatgacggcccgaagcgtcatatacatggatgctgaacgaaccggggacctccgcccaacggacatggaaacttcctttcgtaccgctagcatatacggacacggcctcttgcggagcctcctcgaatacgttctccgtagaggtagggattcccaatatatccagcagacctttatacacgtctatctttccccatccccattgcttgttcggataagagagcggtttatcctgaacagccgtacgggagaagacatccttgatatcatccggggataaagcaggattcgcctgtaaccagagagcgatactgccagtcacgaaaggacaagccatcgaggttccactcatatacccccatggatatcgatgtccattgaaagtggaatagcgagcctgtgatgccttggctccttcaccggtctcaccctccagatagaatgagttataggaggatgccacccaaagtccgggtgctgttatatctggtttcatgcgattatcaagcgtagggcctacgcttgaaaatgatgttaactcacccaaactattacctgccaaataagaggtacccccatctacatttaccgggcatatacgagtggcataagccccgacagctatcacgtttttggccgatgccggagagccgacagtgaaatctcccgtaccgaccgtataaggatacccttttcccaagtccgtaaataagctctcgccattgttgccccaagcccggaccggcgtgttatttgtcgccacatgaagtaagaatatcttttcatttttggtgccttccggataattgaactgaataaaaagacggtatctcccattaaacacatataattcagattccatttgcgcctcatacaccaacgtgccatccacgctctcactagtaaaaacagaagacttaggcattgtatccaaggcgaaaaacccggtagtatttaatatctcatcgctttcgcgatcatacagatccaggcaaacagaaaaaggttccccgggctcgtccgcccaaatatccaccagtccataagaaagacccgtattagacctgcctacaaaagtatgcaaggtatccgaaggcgacatcagttcggtatatactggcatgtccctagaatttcccatggcaaccgtgatgatttttcccggtccgaccattcggtccaacattatatccataaaattagtaccatcgtgtcctccaataccatcccctaaactaagattcaccacgcaaggtctacccagtctctcgctctccttgaatatatagtccactccgtttacgatatcggcctcctgcatggtagtagccaccaagatcatatcactctcgttggccacaccttggtaaggcgtatcaaaccctcctccggcagctatgcccgtgacatgggtaccatgcgtatttacatccgaatcaaacgagcaagccgcatccagcagttcctcttccgtcctgtattccgctttactataaggactcgtttgatcccaaacttgtttgatacgatacgctttaccctccttgtcatagaaattcgggtgagtaaaatctaatccctgatcgaccacacccacgatgacccccttgcccgtataaggctggggaagcttagtccccgcataggcgtccgccacgtccgagtagtaacgggccgagtccatactggccctcatcggctgcgaggctgatacatattggatacaatccagcccagacaccgactccacggcagacagggggatcaacaccgtagcgatatctcccgtccttgtccggatacggcacccggccgaatccaaggaagcccatccctcatccgtcgccaccttcacgaaagccgagagataatctcccgagatagaactcctcaacaacgagttcgccgtatctttcttcgctaatttgtctaaaagaatacgtgtatagggagacatcttggaatacgtaggttcttgggcaaacatccctcctaccacaaaaatcgctagaagcagcgataacaaaatagattttctcttcatattaaccatcttttccattatatttcaattaagacgtaaagctcgtctcatcacgccagccacgacattttaaatgcgccattttatctgtcttattgtgatacaaagtaaggcttttaaatgcggactttcattaagaaaccccgctaccttacgacatttagtccaaaaacagtgtgacatataatccggattcgaggtaaactaggcccttttcatatctaatcgtcacaaaaaacacttataaatcaaagaaaaatttatatttttgttcgctaaaaagtaaatgaatgaaactaacatatataactttattctttttttctatcgtactcttgagagcggcaaacccttccgcagataaccgcccccaagaaaaattatcttaccaatccatattcaatcagatcatcgcaacccccgaaaaagcgataaacctagccgatagcgccgagaacctacggatcataccggaatacaaagcacatatcatccggtcacgggcatacgcccggttgaaaaacgagaagaaagcgctggaatacgctctagccgcattccacaccgattccgtacaaaacgactccacggcctacatgaatgtttgccagatactaagtaattgctatatcgagctatcccgccagaacgaagccatagaatacgcaacgaaagcgatacagatcgcacgctcccaaggcaataagagcgtcgaggctacctctatgatatccatctcacgggcacaaaacgagctggcacaaaaagacaaggctatcgagacacttgaccaagcgattgaactgctacaaggcaccaccgatccggaagaaaagtgtacgttgatctcactttatatggagaagctacgaaacatcatgatccaggagaaaaatgaagaagcaataaataccggaaaggaagtagaggcacttctggaaaagatggaacaaacaggcgatatgcaagagacaagggtggatatgcacctaggttatttatatagcttcctttgcgaagcgtatcaactgatcggagaggaacaagcagcggccagttactaccaaaagttcctcaccaccaaattcgcccaaaagccgcagggaagaacgagagcggacccttacctgctattaataaaagattataagcaagtgatccataataccttggaacgggaacgactgactccggcgcaagataccatcaataaagattatacggtgatgctagcgaagctaaagaatacctattccttaatgggcgactataaaacagctctccaatacagtgatcgcctctccaacatacgaaaggaactgtatgcccgcgacaaggaaaacgcggccatggaacttgccatcgcctatgagacgaacgaaaaggaaaccaagatcatcaagcaggaaatggagctgaagcagcgcaacacatttctcggagcctctctaggcatcataatcctccttattctcttgctttggatctcgtaccggaacagcaaggtcatcaagcgaaagaacaagatcacagtgaaccaagtaaaccaactcctagcctacaagaatgagctattggcgatcaaggaacgtgacaaagaggcagaactatcgcaccaagaagaacttcccaaatcagatagcaagacacaaactgacccagatcaaccaatcgaccaagattctttcatcctgttggaagaaataatgcataaggagaaactctatctaaaatcagatcttacccgtgaggacgtactaaaacggctccacatggacaaaaaccgtttttcccggatgatacagagcaacacggaagacaattacacaaactatatcggcaacctccgcatggaacactccatacagctaatgaaacaatatccttattacaacctagaagccatcgccctcgattccggattgggaaacgtacgtgccttacaccgcctcttcaagaataagatcgggatgacgcctaccgagtataaaaaagccttacatgtgaattaaattaactatttgcggcaatcggtcccaatcccgtacaaaaaacttactttaagcccttttattcaataaattcatctaatttcgcgtcatttataaacgacacgtctctatgaataatgataagatcgtcacacccagcttttgctatatactagcggcgaatttcctgctttttttcgctttctatctaatcctgccgatcttacctttttatctgaaggaagaattcatgatcgggaagtctatgatcggatttatcttgtcgtgctatacgctagcggcgctctgtatccgtccgttcgccggatatttactggatactttcgcccgccgtcccttatatctggtggcttatttcattttcaccgccatatttggcggatacatggtagccacggcgcttaccctctttatcgccttacgcgtcgtacacggtttcgccttcggcatggtgacagtggccggaaatacgatactgatcgacatcttgccctcctcccgccgtggggaaggtattggctattacggcctagccaataacatcgccatgagtttcgggccgatgatcggtctgttcatgcaagggaacttcacatacgacgtgatcttttcctgctcgttgctatccggaagccttggttttatcatggcctatatggtcaagactccttataagcaaccggtcaaacgagaaccgatctccctagaccgctttttcttggtgaagggaacttgggcgggtatctccctattattgctctccattccttatggtatgactaccacttatgtagcgatgtacgccgctgagatcgggatcagcgtaaactccggactttatttcacctttatggccgtgggactcgccgtctcccgcctgttctccggacggcaagtggataaaggacggatcacgcttgttatctccctcgggatgtatttggcggcggccacattctttcttcttgcggcgctcaaggagttgatgcattggaatccggtattttcctcttatctctacataggtatagccctctcgcaaggcgtggcgttcggaaccatgttccctgctttcaacacgcttttcgtgaatctggcacccaataaccagcggggtacggccacgtctacatatctaactagttgggatgtaggtatcggtatcgggttgatggccgggggcagtatcgcacaagagctgggtggcttcaactacgcctacctgtccggcgcttgccttacggtattgtctacgtttttctttttgttcaaggcagggccgcatttcaaccggcacaagctaagataagcgtcacgttataaagaaaccttaaattcccccgagcgtatccgctcattcagttctttcaccaaatccttatattgataccggttaccgcaggtatgaatctctgttagcgggtgtttatcgattaccttctccagtaattcggagcgagacggcgtagatggcaaggccgcgtattcctcgtacgtgtaagacaagaaagccacattgcgcccgataccccggttatccaacagatagccatcggccaaaggagtcgggtagggatacttatcccccactttcacatcgcttaccgccggatacgagacaatcgtctggccatcctcactcaatccaaccgggacatgacggctataatctttcgccgtcttatagatcaccacaggaggagccgcttgcacggaggaagaaatccgtccggaagaagctggtgtcggcaccattccggaaaaccggctgccggtcgtttctaacccggcagcctgcttccgactggaggaacaactgatcccccagcaggaagcgatgaagcataaagccataatcccttttttcatttttgcattttctctgttatcgcataaagatctcccgtgaagttaaaactttccggtacctgtcacaatactattttcttctccgcccaaccctgttcgatacggactttcaacacatagatccccccggataaaccagcggtagaaaggacggcccccgtcccgttcatcacgcccgtagagcaaagcctgcccgatacatcgtataagtaagcctcatggagcggagacgtgaaggatacggacagacggccttctcccgccaggacccgaagcttatcatcaaccgccaatggatggatgcctgtgggaacgccttccacggttacaaatacctctgttccttttataaaatagagaccatcagataccacactatacgcagccagcacgtagcgacccggggataggtttacttttatttgagtacgtacctctttctcttcccctggctgaaagtaagcgccttcaatagacaagtccgtatattcccccgtagacaacgaatgcgccatgaagactatcatcggattacgctcataggcgctctcgttacgaatcaccgtgcacaacacgttcgagccacccactaccaagctctcttccgaatagacagaacgcgtccctgtatattcatcagcgtaggatatcacctctatcaaggaatccgtcgccaacaaatggatttcattattcctcacccttgaaggggttagctcccgccactccttttcgccagatacacgatacaacgccctcaacccgtatagacccggatccaagtataatggatcagtcttccacaaaaaagaaggtgaaaccacagctggacttataacgcccttttcctcataaacgatcttggatagactatctccggtaaagactcctagagcaagttctagctccttctcggaggaggcatctagctgtagggcatattcaatgcccaaagaatcaccttgcgagatcgatggacgatctacattcaccgaattaacattcaacgacagataaggctcgctcgcctccgtgggtttctggaaaccgataatcatatcttgaccataagagaatccgctatacgttttaatatatggattcagcacatccagctcgaagaaaccgttagcggctcctccccaaccccaattgatatggaacaggccgtccttatcatagccatcgcaaacaaaggcatgcccaccactcgtagacgtccccccgtacaagaccggacgtttggccgcgagctcgactttcaacaaccttttccagcctgcggtcatataatagtcacgatgcagacatagcagatttttatcataattaagattctcgatcaatcccttggccatatattcgtccatagttccgctgccagcagcagaatagagcatattaccagccacgcccacagcatacatcaactcggcgacagccttatcttgaacggcggtggaagtagagtcgtacacatccagcatattcttccagtcaaacgtatagccacttaaatccacggggaaaacagtctcgttcacattttcctctcccattcgatattgccctttacctaccgctttctccggccattggtggtaattcatgatctggacggcagccgtagccacacaacccgtcgctgaacgcttatccccatccaacgggcaaagactattgtaaggagcgccttgatcccatttcgtctgtatcaacggctccactcgctccggaaacccatcgtctgaacgcggagacgaaacattctccggaaacacctgttcaagctgcgtatgggcatgatcgatctggcgctcgtattcctcaaaccaacccctcatgttcgacggcatatctcccggatcgaaagagcccgacagggagtaacccagcaccggggcgacacggtcgtcgcccgacaccatcacgaaaccatccccttcccctacattatagatatagtaatacggatcggacgacacggaacgcaggccgctcccctctcccgtatacaccaaccgaaaatcggatcccggggccgagcgtaacataccctgtccctcataaaaagagcgggctatcctcaacgcctccgcctcagtacgctgacgggcctccaacgagaaggccacgctcacgacacacaataaacataacagtaatcttttttccatctattatttgtttttgacactcgcaatgtacgcctttatttaatgacgaatccttcctcacaaccttgagttgtgacattcagtccttagtttatgtcatttgatacaaaataaccaacggggtatgaccgtttccatacggctctttcatttaaccatccgtctttgccaagctggaatacagggatccccaataaaattccgtacaataagctcgtaaaaaggagaccgtatataacacattgataatcaataccccaaaaacagaatgatcttttccggaaaacacgtacatgttttcgcgaaaagtcgtacatgttttccggaaaagtcgtacgtgttttcccgggatccttcctccgaaaacaaaagcgcatgataaaattcacaagaagcgaaactcccatcacttgtatatcccctgttttttacttaatatcgcgtaacgataatcaagctgataagatgaaaataatagcagataacacggttccttacctaaaagggatcttggagccgatagcggacgtatcctaccttgactccaaagagtttactcccacgaacataaaagacgcggatgccttgatcgtacgtagcatagataaatgtacacgcgagctattggaaggtagccgggttcgcctcatcacgacagccacgatcgggtacgaccatatcgatatccattattgcgagaagacagggatcacgtggaagaacgccccgggttgcaacgccgcttccgtggggcaatatgtattatcctctttggtagccgtcgccctccgcaaaggagagagactagcagggaagactatcggtatcgttggcgtaggccatgtagggagtatcgtggagaggctatgcgaggccatggggatgcgtgtgcttcgcaatgacccgccccgtgccgagcaggaaggtgaggatggattcgtatccttggacacgatcgcgaaagaggcggatatcatcaccttgcatgtcccgctgaccaaggagggacgcttcgccacccgccatctagccgatcatgcctttttcgaccagctggaacggaagccttggtttatcaacagttgcagaggtgccgtacatgatacgcaggccttattgcaggccaaacgaaccggcaaggtcagcgaactgatcatcgattgctgggagaacgaaccggatatcgaccgggaattactgtcggaagccacgatcgccactcctcatatagccggtttctccgctgacgggaaggcgaacgggacacgaatgtgcctagagaatataggatgctttttcggtatccgtatcgaaaagatcaaggaagtcattccgcctgccccaaccaacccattcatcgacttgggacaattcaaggagcaccgggtggaaggagccatcttgagaagtttcaacccagaagtaatcgaccaagcactaagagcgaatcctcatcatttcgagcgatttagggcagcgtatgatcatccccgtgagttccatgcttaccaagcgatcaaagctgacccggaagaattcgccgtactccagaaactaggttttcaagtaggctaatgacaaaaaagccttacagtaaactttcgatcacatgaggataatgcgcatactccaaggcatgcactttcgcggctacctcatccggcgtatccgaaggtaataccggacaagaagcctggaagatgatagcgccctcatcataatgctcattaatataatgtatagtaatacccgactcccgctcaccagccttcacgaccgcctcatgcacatgcatgccatacatccccttgccgccatatttagggagtaatgcgggatggatgttcacgatcttaccgggaaaagcctgaagaatcacgtctgagatcttattcataaaaccggccaacacgataaggcagacatcatattccgccaacttttccaagatcggcacaccggcaataaattcctcccgtgaaaacacgaaagaaggcactcccaatttgtttacccgcccatgcacgccaacattacgattatttgataaaacaactgcaacattaacgttttcactgttagcaaaatatcgggcgatgttctcggcattcgtaccagatccggaagcaaaaatcgctatgtttttcatatttttagatgtttaaatgcacaagaaaagaaaaaatgtgcagttttccgcatttttagcttattaaatttgctttgtaacataaaaaattcttttctttgcactgcaaatttaaaaagtatattcgtatttattaatctaaattgaaaaagttatgtctgaagttgctgaaagagtaaaagctatcatcgttgacaagttaagtgttgaagaaacagaagttacaaacgaagcaagctttactaacgatttaggagcagactctcttgacactgtagaattgattatggagttcgaaaaagaattcggcatctcaattcctgacgatcaagcagaaaagattacaactgtaggtgacgctatcgcttacatcgaggctaacgcgaagtaatcaatccttttaactaaaggtatggaattaaaaagagttgtagtaacaggtcttggagctattactcctcttggtaataccctccccgaaacatgggaaggtattatcaatggaaaaagtggcgctggacctattactcagtttgatgcatccaaattcaagacacaatttgcatgcgaagttaaaggcttcgatccgttgaaagttatggatcgtaaggaggcccgcaagtgtgatcgttatagcttatttgcgatcgacgcggcgaaacaagcgatcgaggacgcggcaatggacttggataaagaagataagaaccgtatcggcgttattttcgcttcaggtatcggtggtatcaagacatttgacgaggaagtattgagttatgcgaagatcaaggatacgatcggtccgaagtttaacccgttcttcatcccgaaaatgatctcggatatcgcggctggacatatttccatgctttatggattccacggcccgaactttgcgaccgtctcagcttgtgcatcttctacaaacgctatcagcgacgcattcaattatatccgtttaggcaaggctaacgtcatcatcaccggtggagcggaagctgctgtttctgaatcgggtgtaggtggattcaactccatgaacgcgttatcgacacgtaatgattctcccgagaccgcatctcgcccgttcagcgctagccgtgacggattcgtgatgggtgaaggtggagcttgcttggtattggaagaaatggagcacgcattggctcgtggcgctaaaatatattgcgagatcgctggaaccggaatgtctgccgatgcttatcacttgaccgcttctcatccggatggtttaggagcgaagctggttatgcgcaacgcattggaagacgcgggaatgactccggaagatattgattacatcaatgttcatggaacatcgactcccgtaggcgatatctcagaggttaaggcgatcaaagatgtgttcggagaacatgcttatcaactgaatatcagttctacaaagtcaatgaccggtcacttgcttggtgctgccggagcggtagaggcgatcctgtgtattatggctataaacgatggtattatcccgccgaccattaaccatgcggaaggcgacgatgatcctgaaatagattataaactgaatttcacattcaataaggctcaaaagagagaagtgaaagccgctttatcgaatacgtttggtttcggtggacacaacgcttgcgccattgttaaaaaattcgtgaaataacgtgtttagaaagctatacaaacagctacataaaagaataaggctcctgcataataaaggtagggagccttatttgtctttatcaaagattctaggtttttatccggataatctccagatttacgagcaggccttgttgcataaatcatcatcagtagagacgggtgatggtaaatggcttaacaatgagcgtcttgaatttttaggagatggcattttggatgcggcggtcgccgatattgtctataagcgctacccgaataagcgggaaggctttttgacaaacacacgctccaagatcgtacaacgggaaacgatgaataaggtcgccgtacaactcggcctcgatcaaatggtagtctattcaaccaagataaactctcataacaatcatatgtatggtaatgcgctcgaggctttgatcggcgctatttatctggatcaaggttatgacgtttgttataagtttatccgtgacgtgatgatagaaaagtatatcgatgtagatacactcgtccggaaagagataaatttcaagtcaaacttgattgaatggagccaaaagaacaaaatatcgatctcgttcgatctaatagagtcttttacggatcatgatggaaatcctgtattccaaagcgcgattaaattgctcggcgagcaaattggcataggtatcggttactccaaaaaagaatcccagcaagcggcttctaaaatggcggtcaaaagattgcggacagacaaagaactccagcaacgtatctctgccacaaagaaaaagaagacgggtgaactaaccgatgaaaaagagttttctgacctcccagaggaagaaactgtatgataaatagcagaaggggctgtccaaaaagtgtgacagcccctttttgctattgtttatttcagtaaaaagtattatcttaccgttgcaacaaacaaacattatagcgatgactaagatagtatttaaagagttaacttccaaccaaaatgtactttttccggtcagtattttgcaagttttttacggcaacggatatcgggtacattatattataggataccctatttagcgttcaaattcatctaaaataattaagttcgcatccaaatagagatggaagagagagtcgaatttcgttttcgagtttgttagccgaaccttaaacctacttcttcatccctcgtacgggaaactaatctgaatgccacactaaattaaaaaattatgtcgagaccaatcaagaaaggattaagttattttccactggacaccgatatgctgtccgatcgaaaaatacgtcgcttatttcaaaattatggatgcgaaggtttctccacctacatggcgatcctgtgtgaagcgtatggcaccacgggatattacatccgatacacggacgatttctgttttgatatcggatttacgctcaatctgaaggaagaacaggtccgtgagatcatcggattttgtgttgagatccgattatttaatcaggaactattcgccctgcaaggaatcctcacatctttcggaatccaatcccgctatcgggaagtcaacaagcggagcatatcccgtatctcccccgaatgggaaatccgggaagagaccgcccctacttctacggtagaaatatcggttcctgttacagaaaccccggttttagcgacagaaacagccccaaaaggaaaaggaaataaaacaaacacggtaacaaaaattcaagctagaaatgaacattcgacctcaaatgataacggagaggcaggccgcagagtcgagctactccaaatggcagccaacgccacaagcgctagccgacatgcgtaaacgctacggcgacgcccaaagtttcctatcgatattcacccccgatctacagatcgccgccgcccgtcacccggagcggacctatacgggcacggcccctacgctggccacgatagccgtcggctacggcgagccggtagcgatcgtatggatctgcatccaactggagaacgtgaacctgttcgcgggggtaaaagaaaaaatgcccgtcagccgccaaaaagagctgtcggccttgattctcaccgagtatccatttttaaaagcctccgagatgctcctgttcttccaccggctgaaatgcgggcggtacggacgcttctacggatcggtggatgccttgaccatcaccacctcgctcctgcaattcatggacgagcgacggaaagagagcgtccgctaccggcaaccggacacggcagctcccgccacgaccaccccatcctcgagtggtatcacgtatgaagagtatttaagattaaaagaacaaaaacagcaacaccatgaacacgaatagaatctatggccatcaagagttggcccttttatatttcccgaacgtactcccctcctcggcctccacgcaattgacccgtttcatccgccgggacccggagctactgtctgccctcgaagccatcggctatcgtaaaggcctccgcctctacacgcccttgcaagtgcggaccatcgtcgatcatatgggtgaccccgagaattggaacctttaatttccaagcctcaattatcaattttccagtattaacggcataacggtgatttctcccgtaatccaactctttttctcgagcgaatcacggccgtaaatgttctcaaaaaaacacgtacatgtttttcgaaaaacacgtacgactttttccgaaaacacgtacgtctttttttcgggtacaaatcccgacattgaccgacactgaccgactgcccttttttcagtctcttacctttgcggaaaaaagaaatgatgaataaacttgtatgtatcgggctaattaccctatccgcattgtcttgctcggtttcacgagataacaagcaaagactgtataaacacgagaaagactccctctcggcaatccgtatcgaccatctctttcgccaagccaaaagcgacagccggaatcacctatcggccaccctgcgccaagtaaccttctcttcccccgacagttccgggcggcaatatccgctgtccgtgaccaccgccaccctgcaagaacaatcccggcgatcggcaacagacacctcttccctatccagcgcccaacgatccacgcaaaccagtaccgccacgcacgtatcgcaggagagcaaggagcgaaaaagacaggcgaccccttggtggctatggctagcgccgggccttgccctcatcgtgattctcaaaaaaacgacctcgacaaaataaaaactcatcctatgaaccataaaagaaataagtatcagaaaagaataaatatacaattaacagtagccgtgatgttatgcctagccggcctctcgctgctgttcatgggattctggtgtagccccacgggagagatccataattccgtattaatcggcttcggtgaggtctccactttcgccggcgccctattcggggtggattacaaatataaggagaaaaggaactattaagaaataagaaaacggtaggtgatagtataaatttttttattacttttaccccttacatataatggacttatgagaaaaacctttgtttacctcttaatactaggcttaacctattttatttcttgtgataggccaaaccatcacccttcaatcttccagaaggtagagagattaatgccccaacatccggatagcgccttggcacaaaaacagtgggaacaagcggctttattatccaaacgctatgagttatcgcatgattccatagaaaaagcacgtctggaacaagagctggaaacagaaaagaataaatgtataaccttgagcaaaagaaaagacgttctaacctatgtcatgtaaaaaaatagcggaataaacaataaataaaataataggcaaatgaaaacattcagttttataggagtaaccatcctgtttgtagtgacagggtgtggaggcagtcattcatcgaccgatgagtttattaccgtagatgtaaatgaaagttattcaaccaaaaaagaactggtactgcaagacttcatggatgtggaatacattcctctggaaacaaacgatgagtttattaatcagggatatgtacaagcggttggtgaaaaatacataatagtggcaaattataataatgatgggaatatattcgtatatgaccggagcggaaaggccatccgtaagataaaccgtaaaggacaaggaggggaagaatatataaattttagatgtgttacgttggacgaagaaaacaatgaaatatttataaatgatcactataagaaaagaataaaggtttatgatttagagggaaattttaaacgcagtttgaagcagaaaacagaaggtgactctcagttctattgggaaatattcaattatgacaaagaaaatctgatttgttacgatgaaatcaatgctgagatacccttcctgctcgtatcgaagcaggacgggagcataaccaaggaaataagaccttcctttaaagagaagaagtacttttttcaagtcttacggatggaaaatagtacaagaactgccggaccgggatcttacagcagaatcactccgtttaatggtaattggatgctattagaaccctcatcagatacgatctacacattgatgcccgattgcagtttacgtccgtttatcgcacgaacgccacctatccataccatggatccggaagtgttcttgattccgaggttgatatccaatcgctattatttcatggaaggtataaaaaacgtatatgatttcaggaaagaagaaggattccctaaaacctactttgtgtatgatacccaagaaaaggagttttctaggtatattatatacaatggagattatacttctaaaaatgaattctatatggttatgctgacccctatcaatgcccaaggtgaatcatgggctaccctgaacgctttcgatctttgccgggactatcaaaagggaaagttgaaaggcaaactaaaagaagtggccgcgacattggaagaggatgacaatcgggtggtaatgttggtgaaatctaaaaagtaaaaaaatatcaacagtgatggaaaacaattcatcagctggtggtcatagggaatcacgccaacacgaaggatgccgtcatccggataaggcattggaacgatctgaggtgaacatagagggctttactaccaacaaaaagagcctcaataaatgctagacaacacctttacgaaaatatcggagatattatttgcttatatacaggaagaagtatatgtttgtcgtgaggactctgtaaacacaaatcatcattccattttcatggaatgattcaacttgtgtaatattcattgtttaaataataaaacgcatgaataaaatcatatattacgtatcgatcacgttactaacggttgtttcctcatgcggaaataaagagacaaatgtatccagaaagttgaccttggataattgcccggtcatagcacaggttattaatctgcaaggagatccggtgactaatttagacttttcttccgtaaaggatacattcaatttaccattaagctccttgctatcttcctttcaagttattcgcctagaaaattcggaagacgcactgaccgccgcaggacaagatacccatatagccgtgagtgaccattatattttagtgaaatcttttagggcaggctcttcctgtaagctctataaccgtaatggggatttcatcagaaagatctcctcccaaggacaagggccggatgaatataacttatctatttatgatcagtatttagatgaaaataataataaaatctatctaatggagattcgtgcctctaagatattagtgtttgacctcgacgggcagccacaaaaacacattcctctggcctatataacccataaaggacgatttgttatcaatgacgagaaaaaaacagtaaccgtcatgtgcataccttttcagggaactcccaccgcattgatctggacacaggatttcgaaggcaatatcatccaagaatatccggtctccgaccaattcatgttgatcccaagcacttacgattatgaggtacgggagtccttgaataccaacgcttccgacttctatcttcataattgtatagcctcgcaagacacactttatcattatgacatagactcgaatacgctacaccctgtttttacgatgcatacgggtcatgagccgatctgccattatttcacggagctgcccaatcactttctagtcacttggtatacacagacctcatggaataatgagttaccccgtttcccgaaaatcctagtagacaaacaaagccttaaaggttgtttcgtgaatttgaaatggaatatgctagggaatatagatgggcctaccaatccgtccttcaatcgaggttatttcactgcgatcatggagccttacgcattaaaagaacaattggaaaaagttttgatttccaatcaaaaactatctccggaggtgttgagaaaagtaaaagagttgaataatcgaattaccgatgatgataattgtatcgtctttatagggaagatctccagaaattggcagaagaagataatcccatcgtaatattaatggaataatttttggtagtacgagcaaactgtgtcaactaaatatttttcatccgttgtcatatccggctgagccaaatagacatgaacctatcatacacgatatacccatccggttgcctcaatataaactccttatctattaatatccttaaggaagtattcacgctactcaccgccttcaaatcatactttttgatgaaggcggcagcattgacctcccggacgatcccttccttggcgatcgctttcaatagctggatttgattaaatgtcaacaattggaaataagtctggtaggtatattcttcttcccgtaagatctccatcatgagagaatcaagaagctccggagaaagtgttttttccggtaaagcgaagagacggttcaaaagatattgcacataccaagtatgaccatctacccatgtgtacaccttatcaaatatttcttccggaagctccttcccttccttctcgaagaaagaatgggcaaaggaaaaatacacctccttgctgatcttgtctaaaaataatttttgggtggattgatagaaggggcgcttgattgagaagaatatatattccatcaagtgctttttactccccgaaaagataaaatgaacattcggcaaaaattgaatataagaacgcaataggccttccacccctttctccggatattccatgatttgctggaactcgtcaatagccagataacattctcttccagactgccgcaagtagtcgaaaatctccttcagcgtctcctcctctttcgaagggacgatatccaaggatacagacggaatgcccgataactcatccattgttatcacgggacggcaactcttaaaaaaagaaagcaaggtcttcagcgtagattgagagagactatccagcttacctaagatttcccttcccaacaaagcgacaaactcacgcaaattttgagtagagaaaatatctaagtagaagcacttggcattcttctccttttcttgtagcgtataaaaaacattcttgatcaaaccggtctttcccatacggcgagggcttaccaacgtgatatttctcccattatgaagagcggataaaatcacttcagtctctttctcccgatcacaaaaatattctggaccttgataaccaactattaaaaaaggattattcatattcagcatcttatttgcattacgcaattcacgtaacgcaaattacgtaataaaaaaccagaataacaagtaaaccgactactacttacatatcccgacactcaccgacactcgccgattcccgtttttcagagggtctatctttgcattgtcattagtaattaaccttttaaaattcaaaattatggcagtgaaatttaaagtagtaaagcgtaaggtattgaacggcgcagagaaagactcagtaaagaactacgcgatcgctaaaacgtcggggacttcggacctcaacaaattatgtaaactgatttgctctcgctccacgctttcgtcggcggacgtgaaagcggtgctcgattcattaaactgggcgatggatctggaactttcctccggcaacgtggtgcaattgggagaatttggaaacttccgtatgtctattaactccgaaggaacgaatacgcccgaggacttcgacgccaccaagataaagggggcacgtattatctttttcccgggctcggccctgcggactacccgcaatgaggtgaatttcgagcctctggaggttacgaaaaagagcgcaggttctgatagcgaaagcccggacgagatatgagaaaaattgacctgatcgtgattcattgctcggcaacccgtgagaatacggactatagcccgaagcaactggagagtgaccacaaggcacggggattcctccgtgccggttacaacttctacatccgtaaatcgggagaagtggtgaacctgcgcccgctagagcaaattccggctcatgcgagaggacacaacaaacacagcatcgggatttgctacgagggtggactggacatcaccggacagccacgggatacccgcacacaggctcaaaagacctcgttgttacgtttgatccggcatctcttaatctgctttcccggttcatgggtctgtgggcaccgggatctctcggaggacttaaacggagacgggacgatctcgccggatgaatggatcaaacaatgcccctcattcaacgcgatacccgaatacaaagaactcgtgtatgagctacgaaaaaaataagtaaaaaatctatgctcccactaagggttttcaaatttggttgcgactattagtatagaaacaacttaaaatggagaatagcatagatcatattatcacaaggatattaagtggcaacagctcctcggaagattttctttcgctgagcgaatggctgaacgcagacgaaaagaacaaaaaagaatttcggttgctaaagagttattgggatgcggaagtctcgttcagccattccttaatgcctaatgtgtccctcgataatttgagaaagaaaatcgatgatcaaagcaggcaaaagagattgaggctcatccgtttcatcgctactcccattgcggcggcaatcgcctttcttgttttgtttttcgctacgacgcacttaaatacccgggaagggaaggttcagcaattctatacctatataaccgataaaaataaatctcattttacattggatgatggtacgaagatcattttgaaccggaatagtcgctttacctactctgacgcatacggtacggatcagcgaaaggttaatttggaaggagaagcctatttcgaggtggcgaaaaatccggaaagacctttcatcgtcgatatgggaaatgcctccatacgggtattaggtacgacctttagtgtaaaagccgataaagggaaggatcagatcacggccgtcctgctggaagggtctatccgtttcgaaagcccgacacaacaagtcttactagctcccgaccagcaacttacattcatccgttcaacgaacaagattgatatccaatccgtcaacgcaaaagaaaatctggcatggaaagacggcttgctaaagtataaatcaatagcgctttgtaccttgctgaatgagcttgagaaaaaatacgagatcccgatccatatagaaaacaagaaactgatggacccgaatgtcactgtatccggaacattcagcgaggatcaatctttaaaggagattttacaagtaatatctcgcagtttgccgatcaaatggtcacaaagagatggaacttactatattcaataaaataaaaatatcaacacatcttaaaaaaacaagcaatgcctatgagataacacggatcatatctttcaaaaaaacaaaaccggctgcaaaaatacagccggccccattaaaaagaattaattcctgcttctgctactccacgaccaaattttgtggcagacgcatattatcaaccttttatcagtacaaaaatatggaaaatgtttcgtattataggtcttttaggtccaaagacttaaaaaaaatgctctcggtcctaaaaatgtcctttattttacttttcttgacactgttccaagcggtagcgactaattcctattcacaatctgtaacgatttccgtgaagacagatcaggccccgctaaccgatctattcgctattatagaaaaacaaagcgatttcttattcttctatgtggattctgacgtaaagaacgtaaaagtgagcgtgaacgcaaccgataagtccatagaaaatatcttatcgcaagcactacgcaacacgagtttgaaatattcgatcgaaggacggaatatcaatgtatttaataaaaacattgtcgcccagcaaactaaaaaacgtattaccggtgtcgttaaagatgcggaaggaaacgctattatcggcgctaacgttgtcgagaaaggcacgaccaacggtacgattacggatctggacggtaaatacatgatggaagtatcctcaaatgcgacccttgagttttcctatatcggttacatgacacagttgcaaccggtaggcggcaaaaacgagatcaatgtaaacctgaaagaggacactcaaaaactggacgaggtagtcgtagtgggttacggtacgcagacaaaacgtgagattaccggctctatcaccaatgtgaccgctgaggatttcaaccaaggtctgactcgtaacgcagcggatttgttacaaggtaaggtggccggtttaacgatcaatacgggttccggcgacgtaacgggcaactcgacgattcaattaagaggtatgtcaaccttgcaaaaggaccaaggcccgttggttgttatcgataatgtaccgggcatggacatgtctacggttaatccacaggatatcgaatctatctctatcttgaaagacgcgtcttcagccgctatctatggttcccgttcagcgggtggtgttatccttatcactacgaagaaaggttacgccagcaaaccgaccatcgcttataatggagcgttcggtgtatctaccttggccaacaagccgaatctgctgacggcggaccaatggcgtagctatacttcctctaccccgggtaaggatggtaaggattttgacatgggagcgaacacggattggttcgacgagatcacgagaatcggtttccaacaggatcatgccgtgtctttatcaggaggtggttcacaccataactatagaggttccctttcttatatgcaacgtgaaggtatcgcacgcgataactccatgaaccgttacaacgcccgtttccaattctcccaacgtgcgctggaggatcgtttgaaagtaagcatcaccggcgtggctaccgttacggataacgcaccgacaaatacgacaaacttcttgcttgcctacaatatgattcccgtacgtccggttaagctagaggatggatcttggttcgacacacgtgaatacgaccaaggaaacccggtacgtaaccagaaagagaatacacataagaaccgcatcaataatttctatggaaccgctgatgtcggttatacgattatcgatggcttagaggctaaagttcttttagctaaaagccggaacacggaagatgagagtaaatacagtagcatcgagtctcaagccggctacaacgatggcggtaaggccgaacgttggtcgagattgcgtgataaggatttgatggaatggaccgccaattactcggcagagttcaataagcataagatcaatgccttgatcggttattcttgggaagaggagaactatgaggagactcacgtacagacccgtggtttcgtcactgatttattaggcgctaacaatttggccgcgggacaaaacctgaaccccggagacgcggagtctgagaaatggcaaagtcgcctgatctctttatacgcaagagccaattatagcttcaatgagaaatatatgttgacagctaccgtacgccgggatggttcttccaaatttggaacgaataacaaatggggtaccttcccttccgtttccgtgggttggaatatcacccaagaatcatttatgcaaaaagtaaactggcttaacgacttaaagttaagtgtcggttatggtatcactggtaatcaaacaggattggacccctacaaaaccctcgagctttacggcacagatggtgtatattatgataccggttcttggttgccttcttataagatcagccagaacgccaatccggacctaaaatgggaacaaacagcgatgttgaacatcggacttgatttctccgtattggatagccgcctaggaggtcgtatcgaatggtataacaaaaagacctctgacatgctttatacctatccggtaccaacccctccttatttatataataagatcatggcaaacgtaggtgatatgcgtaatacgggtatcgagctgagtttgaacgcagacgctatccgcacaaaggatttcgactggaacatttccttgaacttggctcacaatgaaaatgaggtaactcgtttatccaacgatgtattcacgatggataagatcttattaggtgacgtattcatccggggtggaagctccagtggtacgcacgtattggaagaaggacgccctatcggacaattctacggtttggtttgtaacggtattgacgagaacggtagatatatcttggtagataaagacggcgacggcgagatttccgatccggcggattacgactacatcggttccgcacagccgaaattgacttacggtatcaccaactctttccgttacaagaattttgacttatcatttttcttgcgtggaacgatcggtaatgatatattgaacgcgacccgcatggcatacgctcaatccggattcctgccgggaacgaatgcgctggacgatccattgacctatacgttaagcgaaactcctagattctccaactattatttagagaaaggatcttttatgcgtctcgacaacttgactttaggttataagatcaaagctttgaacggtatccgtgtttatttcacggcacaaaacctattcgttatcacgaaatataaaggtcttgatcccgaagtccctatggattcaggagacggtttaaccccgggtgtagaacctcgtgaattttatccgaaggcacgcacattctctgttggattaaacttgaatttctaatacataaacagtaacgatcatgaaaagattattcaaaaatataatatgtgccgtactcgctccggtagcgcttgtctcttgcatggatttggacgagaacgtatacgacaaacttcctaccgacgaattcgggacaacggaaaagcagatcaacgcaatcatggctccggcatatcaatctttgaaaaatatgctagcctacgacggtccttggggggcggccgatatgacagccgatatcttgatggcaccgacacgtgtaggtggtgactggtgggacggtggacagtatatggaacaatgtatgcatagctggaaaccgaactcttactctgtagaaaattgctgggattattgtacgggaggcctaactacggttaactccgtatataatattatagagaaaagcgaagccatgagcgatgagcttaagcttcaatacttgtccgagttaagaggattacgcgctttctggtattatgtaatcgtagatatcttcggtaacgctccactagtgacagattttgaagatacctccttgccctccagcacaagccgtgcggacatttataaatatgtggttaaggaattaaccgagatcatcccgaacttgcgctccgatgtatcagatgccagctacggtaagtttacgcaaggtgcagcccgcatggtattggcgaagatgtacctcaacgccgaggaatggatcggtgaaccgaactggaaaggtgttgtggagcagtgcgacgagatcatgaaactcgaatatatcatcgaaccgaattggaaaaccaatttcgaggttcataacgaggtatcacgagagatcattctcccgatctgctacaaggcatccgatgagtggggcaactctatccatctttggacattacattatctggatcccgatgtattaggtttcaccggcggtatgtggaacggtatcaacgcccaaccggattttgttcgtacatttgatacggaagatcctcgttacgaaggttcgttcttgatcggcccgatgatcgaccctagcacgggagagattttgaaaacgaccctaggacatgacttgatccatacgatcgacttaaatgtagtagcgggaacagagaaaaccgatgcggacggtaacttaaccccgtggggcgaggttcaccaagaagacggcgcacgtatcaataagtgggtatatgagaaaggcatgcaaaataccaatatggagaacgatatcgctattttccgtctggccgatgtatacctgatgaaagcggaagccttggttcgcatgggcggggatctcggtgaagctactcgtctggtaaacgctatccgggaaagggcttatggtaattccgatcataattacacgagcgtgacattagatgatatttataacgagcgtggttatgagttggcattcgaatttgtccgccgccaagatatgatccgcttcgggacttatctgaaaccgagatatatgaagccgaaacagactccggaatatcgtaagatcttcccgatcccgttcaaggcttggcagaagaacaataatttggttcagaacccgggatatccggcattctaatcatatcagtctgtttttaatatcaattctttagaccccaattcaattattaatcataatatgaacaaatttatgaaagaggtaaataaacaatccagtccgactggaatctctagaagggaattccttgggatggcagccacaggcgctgccgcccttacgatcctgcccagctttaccgtagcgggattaggacatgtagctcccagcgataagctttatatcgcgaaagtaggctgtggcggtatgggagccgccgatttgggtagcttgatgaatacgccgcacaaaaacgcggcgatcacctgtctgtgcgacgtggatgaccgtcaatctgtcgacgctcgcaagacctatccaaaagctaagtattttaacgacttccgtgagatgtacgagaaggaaggtaagaacttcgatgccgtatgtatctccaccccggatcataaccatgcgatccaagctttcggcgctatgcggatgggtaagcacgtatatctgcaaaaaccgatcgcgcacgatatttacgaggcacgtatccttaccgaggctgccaagaaatataaggtcgtgacccagatgggtgaccaaggtaactcttgcgacggtatgcgtacccttcgtgaatggctcgaggcagatctgttgggtgacatccagaaagtatattgctggaccaaccgccccgtatggccgcaaggtattccttggtcgaaccagaaaccgcctgttcctaaaggcttgaattgggatttatggttaggaacagcggagtatgtagactatgtggataatttggttccgttcaactggcgtggttggtggcgtttcggtacaggcgctcttggagatatgggttgccacatcatcggccctccattcaaattgcttcaattaggttatccgaccgaggtttcttgcaacacgaccaatgtttactccggtatcttcgaagaagcctattatcctgaaagttgcccggtagccagctcgatccgttataaattcaagaagaaagacggaagcgacttgagtctgtattggatggacggcggtatcatgccggaacgtttcgaggagatcgacccagatgccgatatgacctgcacgatgggagacttggatatgatggacgtagaaggcgcaaccgtattcgtaggtacgaaaggtatggcttcttgtggctggggtggttccgatccaagattctggccgaagggggtaaaagcgaacaagaaacctttattcgacaaagacgtgaacattcctcataaatataaacgtatcgaagggggtacgaatggccactattgggcatggatcgactcttgtatcgcagggtacgataaggcaaacgtagaatctccgttcgaaggatacgccggtccgttgactgagaccgtattgatgggtaacttgatcttacggagccataatatccgggaacaagtgaaacataacgactcgatctacggagagcgtgaaggcttcatctatccgggaagaaacaagactttcctatgggatggagcgaatatgcgtatcaccaatttcgagcaggcgaaccaattcatcaagcggaaataccgcaatggatgggaagacctgaagttataaaagctaacaggaatctaacggtaacctaacaggaacctaacaaattcctaataattatctaacaagtttctaacaaacaacaaacattcataatagcgatgaaaaagatttatagcagtattatggccgtagccttattcgcgtcggccctgtcatgtacctccggcggtaataccaacgatgccggaacgcaaaccgcccaagcccaagccctcgatagcgacggtatccctacgggaggcgagtggatcaccatgttcgacggcaagaccttgaacggatggcgcggctattgccgtcaggatgtaccccaaggttgggtggttgaagacggatcgatcacctataaaggtagcgacaataaggcagacacgggcttcggcgacttgatctacgacaagaagttcaaaaatttcgttttcgagatcgaatggaagatcgacaaggccggtaatagcggtatcttctatacagcgcaagaaattgagggtacacctatttattactccagcccagaatatcagttactcgacaacgagaatatgccggacgcatgggaaggttgcgacggtaaccgtcaggccggtgccgtatatgacatgattatgccggatccacaacccgtaaaaccgtacggaaactggaacaagacgagaatcgttgtctataaccaacgcgtgatccattacatgaacgacgtgaaagtgctggaattccagttcggtacaccggtatggcgcgcgttagtgaatcatagtaagttcagcaagttcagcacgagtccggagaaatgcccggaagcttacgacttgatgctacaatgcggaaaacaaccgggttacatcggtatgcaagaccacggttatggtgtttgcttccgcaatatccgaatcaaagagctctaaaatcgtatgagaatagagatttgtcaatcttatgaggcattaagccttaaggcaaaagagattgttacctcagagttagggcagcacaaggcacttacgctttgtgccgccactgggggctctcctacccggatgtatgagttactggtagaggaagccggtcgccaaccggaattattctcccaattcacggtactaaagctcgatgaatggggaggaatcccgatggatcacccgggtacgtgcgagtcgtatctacggaactatttcgtaggtccgcttcaaatcccggaagaccggtatatagcgttccaaagcgatccggagaaccctgaggcggaatgtgagcggatccaacagatactggaccaaaaaggccctatcgacatttgtatattaggaatagggatgaacggccatatcgccttgaacgagccggctccttccttacatacgaattgccatgtggctcatctgtcccagaaatccttgcaacatcccatgatcgccggggatacggagaaaccgggatacggactgacattgggcatggcgaatatctttcagtcacgcctgattatccttcttatcaacgggataaagaaaagggagattactcaagctttccttgaacagaagatctcgacggagttgccggcctccttattgtggctgcacccgaacgtgatttgcctgatcgacagggaagcggcgcatagttctaattaagcttttacaattatcatgaaatacgctatcgcattagacattggaggaacaagcataaaatatactcttgtgaaccagaatggcgacattctttacgaatcgtcggaaaccacacaatcaaaagagaatccacgcccattatccgataccataaaaagtatcgtacggaaaatgacagactacgcccgttcccgggattgggggatttacggaattggcataggtgtaccttccgtagtagataagggggtggttctctttgccaataatcttcctgaactggataaccaacaattggatcttgcgttagcggaatttaatctaccggtattcatcgacaacgacgcaaaccttatggggttgggcgaggtgatatatggggcggctaaaggtctctccgatatcgttttcctgacggtgggtaccggcatagggggcgccttgttcttgaacggccggctttatggcggctaccggaatcggggcaccgaacttgggcacttaattattcatggtctgaatgggaatcaatgtacttgcggagcgtccggttgcctagaggcacacgcttccgtaagtgcgttgatcgccttatatcggcaattattggagaagaacggacgggagataccttcccgtatcgatggaaaatatatagtagagcgctataaagctcaagagaaagaggccgtactcgctatggaggatcatttccggaatctgtccctaggcgtagcgagccttatcaacattttcgctccgcaaaaggtgattatcggcggaggcatttcggaatccggagatttctacattgacaatatacgggagcaggtcgggaaatacgtgatgaaggaaacctcgtacttcacgactatcgagcttgcccgattaggaaataaggccggatgcctcggggcggcggcattggtgtttaatcattgaatctatctatcatgaataagaataattggatcgtactcctcatcttgtgtatttggtttgtcatttcttttgttaccaatatattaggccctatgctaccgatgattatcgatagttttgggctgagcctgacattggccgcattcttaccgttctcatttttcttggcatatggcatcatgtcgatcccggcaggaatgatcatcgagcgtttcgggggaaagatttccttattgatcgctttcagtctggcatttttgggtgcggggcttttcgtcatgttcccgacctaccctatcgtattaacttcccttttcgctatcggtctgggcatggcgatgctacaggtgatcatattgcctttgatgcgtgaggcgggtggagagaaaaaatatgcctttaatcaggtattggcccagatcgtattcggggccgcttctttcatgagcccgttcgtcttggccggacttatgcggaaattaaccggtgaggattcggcaaacgacttcttcatccgtttcctcaaagggataacgccggagagcttaccttggagctcgctctattttatctttacgattgtttttgtcatcatgttagtggttatctcttatgtcaaattcccgaaagtagaattaaaggaagatgagaaggcgggaacgatacaaaattataaggaattgctcaggcaaaaacaagttatattctatttcttagggattatcgcttatgtgggaaccgagcaaggattggcgaattggatgagccttttcttgaatatgtatcatggggtcagcccggaaggagccggggctactacggttgcttggttctggggattgatgtccatcggttgcttgttgggattggtgatcgttaagttaatcgactcaaagctgatgttacgtatcttctcgatgatagcgatccttaatttagcgatagcgctcttcggtcctacgcaagtagcgattatcgctttcgcttgttgcggcttctcgatctcgatcatgttttcggtgatattcgccttagcccttaactccgtggataagcatcatggggctttttccggtatcctgtgtacgggtattttcggtggggcattgattccgttcatcattggtggacttggagatctgatcgggctacgttactctatgttcttcttgtttatcacgctcggttatatcttaagcatttcctattgggcccatccattggtcaagaatgaaacgattcatcttaaagatttgctgaagcaactcatccaccccaaaaatacatctaattaaactcccctagttgtagagacggggcgtgccccgtctcaccaccgtctgatagtatctttagttaccattttgctgggatgagacggggcacgccccgtctctacaactagatgaatttcctcaaaagaaagaggaaattataattagtaagcattatctttgaaacataaaatcagtatccatgaaaaaagaatctatctacttaatcttatttttcacgctattcagcctttctatctatgcgaacaagaacgtacgattgacctcgccgaatggcaagatcaagttctcgctggccctaacggaaaaaagtccggtatataacatagagttcaataagcaaatgctgatccaagactccccgctgacattgacattcgataacggggcatttggcgagaagctgaagatgagcaggccggtgttcagcacgaaagaagagacctatgagctgatcgtcggtaaggcgaaacatatacatagcctttccaaagaggtaatcatcccgctagaggaaaccgttcagccttttcgcaagattaatctggtcgtaagggctttcgatgacggtatcgccttccgctatgagtttccgaagcaaaaaggatgggattcgtatatcatgtatgacgagggaaccagcttcaacctacaaggtaacccgagcgtaaccactttattcctccccaactaccaaagttcccacgaaggtaaatatacggtcacggattatgccgacatggataataaacgattgatggatatgcccgccctgttctctttcccgaaccatgtttatatggcgattaccgaggcggcggttcgtgattacgccggtatgtacttatggaaagaaaacggggctcttctcgggaaactatcacctaaactgggacaagagcgtatcaaggtagaggcatccctaccccatcaatccccttggcgggtcttgatgatcagcgatcaaatcggttccttgatagcgtccaatatccttacgaatctcaatgagccttgtaagatagaggatacgtcttggattaagccgggtaagactacttttacgtggtggaacggaaatgtcgttccggatacgactttccttggcggaaacaatttacccacgaataaatattacattgatttcgtagcccgtaacggattggattatcactcgatctacgggaacgccgagcaagcttggtatgacgaggatggagccggattcggttctccgggcccgaaagcggacatcttgaaagtcgttccgagcctcaatatgcaggagatttgcgattacgccaagagccaaggcgtacgtatccatttatggaccaactggaaacctctgtacgcgaagatagacgaggctttcgcccaattcgagaaatggggaatcgccggcatgatgatcgatttcatggatcgagacgatcaagagatgatccgcatccaagaagagttcttggcgaaggcggccaagcatcatctattcgtgcaattccacggagcttgcaagccgtctggattgaaccgtacctatcccaatgagttcacccgcgagggtacgcttaattatgagcattgtaaatgggacaaggataccgatgcggatcatgacatccatatgccttttacccgtttattagcgggagcgacagattatcatttaggtggtttccgctctttgccaagggataagttcaagaaccaagaacgtaacccttacgtaatgagtacccgttgccatatgttagcgatgtacgtggtattagagagctatctcggcatgatttgcgatacgccggaggcttacgagggacaaccgggattcgagttcctgaaagccgtgcctacgacttgggaccaaacagtcgttccgaacgcttccgtcaatgaatacgtaacgatcgcccgcaaaaagggagaggattggtttgtcggtacgatcaataacagccaagcacgcagtatcgatgtagacctcaagttcttggataaggacaagaaatataagataacgatctataaagatgctgaagatacgaatatagactcgaacaaactcgtaaaagaggttaaggagatcacctacagggataaaatcacccttccgctggcctccgacggaggatcggtctttcatattcaacccatctgacgcaatccacccactgcaacccgggttgcagtggtactgcaaggctgatgcagtaatactgcaacgcccgtgcagtaacaagacacaaagctttcggataaaagcaagtattggaggaaccggaacaattgattacttttgtcctcaaaagtatataaatgagttacaattggaatacacggacggaacttttgtttggagccgagcgtatggagcgcttatcccgtagccatgtattggtagttgggttaggaggtgtgggagcttatgccgccgagcagatttgccgggccggagtaggaaagatgacaatcatagacgccgatacggtaaacgagagtaatatcaaccgccaattgcccgcccttcattccaccctagggatgccgaaagccgaggtcgtagccaagcgtttgctcgatatcaatccccagttgcaactaaccgtcctaaatgaattcctgcgagacgaacggacggaggaggtactcctatcggcccctctcgatttcgtggtagatgccatcgattccctaagtcccaaagtattcctcatgtaccaggcttatatccataagatacccatcgtgtcctccatgggggcgggcgctaaggtagacccgtccttggtacggattgcggatatctccaagacaatcaattgcgcccttgcgaaagcggtgcggaaacggttgcgtcctctaggcgtaagcaaggggattcccgtcgtattttccaccgagttcgccgatccggacgccgtgatcgaagttgaaaacgaaacatgtaaacgtacgaccacgggaacggtctcttatatgccggccacgttcggttgtttccttgcctcgcacgtcctaagaaacttgatatgatacaaaccaaaggaataacgaaaagtttcggtgccttacaagtattgaaaggcatcgacctcacgataaacaagggcgaggttgtcgctatcgtaggccccagcggggcgggtaagacaactttgttgcaaatcatcggcacgctcgacgcaccggatagtgggcgactggttatcaatggcacggagacaagacgattgggcgataaggaactggcggctttccgcaaccggaatatcggcttcgtcttccagttccatcaattactgccggagttcacggccttggaaaacgtgatgatcccggcactgatcgccaaggagaaatcggccgtggccgagaagcgggcgaaagagatgctggacttcctaaaactctccgatcgcatggcacacaagcctgccgagttatccggtggagagaaacaacgggtagcggtagcccgtgcgcttatcaacaacccggcggtcatcctagccgacgagccttccggaagcctcgataccaagaacaaagaagagttgcacgcactcttttttgaattgagggaccagatgaaccagacgttcgtcatcgtgacgcatgacgaacaactggctacaaatacagaccgtgtaatccatattagagatggagtggtagaagctgcttattgaacccgcagcttcaccgtcttctggtcgtgggcgatctccgcacggatgatgtagatgcctgccgggagatcgaacgtataagtcggacgagcgggatataaagtacgtaccaaacgacccatcggcgtaaacacctgtatccgcttcaacgcctcgctagcactggccactaccctacccgatacggcggaatagacagagatagattctacgttgtctaccccctcattaccggtaggcgagcccgcacttaggaagtaacgtccatggctgctaccgtccaaacgcaaggtatacgtattgtccgacagctccgtacttttacgggtcacggcatcgtacaggtaaagcgtctccgcccaatcgccgataccctctatcgtcagtgtaacctcgcccttaccctcgccggcatatacgccaaggggcacttggtcgatccgtcgtactacgttcacacccacggcacgagtcccggcgatagtgtatacctgcgggatctcctccagttccgtatccagcaagattacggcatccttatctgcctcatagctgttcgtagcatcatcctgccgcgtcagcaaggccgtgctacgatatgcatcccgctccgccgtcagcctcaataccgggttcttggccgtagcggtacgcaaggaagaagagaccttctccggctctccttgcatcatggagggatcgaaatgaacgaccttcagatcggcaccggttgtcgtaccttccgctttcgttttggccgcatctttcagctctacaaagaaggcctgcatgggggcgataacggctccagaagtagcatcagtatctccattttcccatgccacatcaggcgtaccgacaacaagcccctctccaatcttcgtatccaatgtccaatatttttgcgctaagatagtctcattccctttcaagaaacgagcgatatccaacggatacatatacggattacccagcaggaagtgcttaccgtcgccatcagcaatgacacggacggttccattatccgtattccaccattcttccgttccattcgcatctgtcaataccacctcgataggctcgttatccgccagcttgccggcattgatccgttccgctaaagtcggggctttggtcatggcggctctcaatgtagcgtttttcgtctccggtttccacggttcatagtcgtaagagtcatccgctttcggcaggcgtaccaagacatttccattcaaagcacccgcattcttcttttctacgctggcatagaatccctttcctaacgcataagggacgttcacatcgttgtattcacggctccaattggattggactacctcgtaatgagttgtatccaaatcactatccggaaaagaaactgtttgatctgctccatccttcggcacgtacatcgtgatcgccttgtcccaggctttctggtagaaggcaggggcctgacgatcgttatcagccgtgctgtaggtgatatcggcgaaagcataggtgttctgacggcccgtgttcttcacggtgtacatatcaccggcgaatacgctttgcaggggcgatgccatccaatatttcgcattaggtgtcatttcgaattccacacgggcggtgtcatacgtcaagagttgctgacggcgtaactgcgcctcgggtttgaaatagatggcctttaccttatttatatagtacggagctacgataagtcctttatcattcttatttaccgccatatcatattggatatattgggtagcctttgttttagatgtcgtatcaatcccttgcagtaaattcttatcctctttcaagtcttccaattccagcgtctgccctcccgggatcgtgatacgggtgaaatgaagcggggcgaaggcggcagtcacaagatcattaccgttggcatccgtaccgtctgttccctttggatctatatacaattcccctttcgtagactgatgccagttagcgtcattataccatgcctcgccggtgtttgtaccctgccaagtcagatactccggtacgatcttgacaagcaaggtagcatatccctcgcaagagccttttacgaaaattccgtccttatattcaccgaatggaatatagagtgaatagatttggccttcggcgaagtctttataagcatcctcattaaaggtcatcgagaataatccgccgccattatcacttccacctttagctttcgcagacaaattcgtcaacttacctaccgcagtatacgtctgcccttgtcgcaagaatatagtcgtagcctcatcatccttgtcaccatacggcatacctaattggttagattctttcatacccattgtcaggccttctccttgaatgggaatatccgttatgcttccctccatgatattcggcaagccgatacgcaggggtacatagggataatactccattccttccgggtactccacatccgggaaaccggcaagtagtgtcggagcgggagcggcttccattgttaattcgtgaggctcattacaaaagagccatatacgtcccttttcatcctcatgatcatcaggcaagtaaggaatcgccaccaccttttctgtccagcggaactctgcttttccatactcaccaccaatcactaatcgtggctcgttgtctacatcacccaaaagcaattccttcaattgtcgggttacctcttccttgtagttttcttcgcagtaccgaatcaaaccatccgcagaagcttcagaacccttaagctcatctctataagagcgcaatatatccgttaaccccagctttccgtcaagagttgcaaaagccgacgaatctcccaagaaccaatcgaatgtatatggaacatcagggaaaactttttcaaactcatctgttaccccaagtgaattattgtcgtcatctacttcttccaccaacacggtagccttttcaatcacgctgatccgtccctcgcaagcgatcgcaccctccgggaactgggtcttggtatttgccacgatcgtaacggatgggagtacggtgaaaggaatcgtcagaaggcaaggatcttggaaactacttcccgcatatttattcgggaaatccacgactccttcatcagttacagtagcggccgcactaaaaatcaccacatcatactggccggaagcagcattctctttacttccaaaatttcgctcgcctttatacctcagctctgtcttgttcacatcaatggcactcaactggatgatattttcatctgccgcatcccaccaaggcacacgaggacgagagatacccatcaccgaacatacggctcgtatcaattgttcatatatctcataaccgttcatgaccgcatctatattaatattttgcggatccggtacgatatagtcccaattttgtttttgacaaagtgtttccaaaccctctgtcaaatagttgatataggctgccttatcctcgtatggtccaccatatttttttgtaacgagtgtgtctatatccgcattccaaacgttggtcttggcatcgtataagaaatcattgatcatacgtaggttgacaacaatctgccgatgcattgcggtctcataacttgtcagaccttgaaatccatcatgatttaaccctttctctgtcggaacgatgatacgatacactttgcttcgattgttatagttctcattcgcatagtccttcaaatccgtattcaatgtaatccagtcttcaggcttgtctatatccccggtttcctttttatcggtagctccgacataaacgtttccaatcgtttcattaagattctcttttcttttcttcggatcactccccatcaaaccatagcggtatttccatatatgctttgagtcttccgtaacaccgtctttcattctatctttaatggtagccaacgcatccggttgaatgctccagcccatattctgaagcaaaagctcatattccgtagaaacggtcaggttggcagaagaacacacgtctactcgtttcacgtcgatcttgggcttggtgcggtagatacgcagaccatcgatggcgtagtccgcaccgttagagtgaagggtgttgttttgtacttccagataatatttttcataaccaacaagcgattcgggcacagagaaggtgtacattaattgttgccatttgccgatgttacgatttgtccaagatcccccatttacaattgaatcttggagcgcatttcccgaagaaaaacggtgtaaaatgacttcaacctctttaccatcctcccccttcttcactccgataaaattcatattaatattaggaggaagagtacttctagcggaggaaagagtcatatcattcacccaaaaattaaccagaataccagtatgctggcatatcgtaccatccaattccattttcaccaagcgtcccggcaaattcgctgcatctacataaaagaaatagcctaatgatttttttcccgtattataataagtccgatcgtagattccttctttactaggagagctaccaaggagcataatccaacgatattttctgttagcaattgattcattattcgttgatattccctctatattcgcagtacgaaataatccatattgattttgcaggggtttaagattattttctatgatgtgattcttataatcatacggggcatactctgtaattcccaaatccaaccatttcccgctttctggaaaaccaatcggtgctatattgttctccgagtttaactcatctacggatatagtatcaccccggtcgaaatttatatgcccgattctctcataaagatccggatgattatccgggttacgtcttgtatcatcggatatttcttgccccgactgcaacataaaaccataatcaccggggataagcttgtattgagctagcacaggactcttcttgccacttgcacttatcgcccgcacatcatacttcacaaaatccgtgtttacctctatcgaacttatcatctgcttccaatgaagtttatctcccgattcaatatttgtccatgtccctccatctttgcgatattggtaataatctccctgcacaatagttctattatcatcatcgtaccacgcatagttattggcaatttggcccaattgtatattgatcgtcttgctgttttcaggaacgtatatatcctctttaataaaaggaatcatatcattcgctccggaagcttttattcgctcagcgatctccttagccggacgaataacgaacttatagcgtacggaaagggttggttctgtaaattccttggaagctatgtttttatcattataatctgtattttggctcacatcacaaaaaacaacatcgtctttcaccgtctgtacttgatattcaatcgtagacgctcccggtacatttttgcctgtggcaaaacctttataccaaaaaagagaagttcctgcatcccgtaaacaagtaggatacttgttcggttctaaagaacctccctccacaaaagaaccatcatccataggatttacatctttaccttttatattatcctttgtcaaggtttcaccatccaatcgataccaacggacataccaatcatactctgatagatgaacacttctcaactccggaataaacaactccctcgcttccccgtccgctatatacaccgtatccacacgttctgtaatatcggtttggggtgaaccattcttataattgattgtgtacgtctgcccccacgccggcgcaaccgcaccggcggacaggatcagcaagcaagttaataacagggatttatatcgtaggttgattgatggtttcatccgtcaggtcctcctttcttagtttgttgttgttatattatggttgttgttgtttttcgtagtttcttatttgaatggtgtaagggatttgcatctcttgctccatgttctcgccgtattttatcacgagtgtgaggacgaccgtggcatccgcttctccgcccagttcttgggtacggatcgtgaaagagccggctttcttcagaccgccttgtcccgtacccggcgtaagcgcggtttcgggaatatccaattccgcatccgtctcaaagctcgttctgtctacgtttatggccgtgattagcggtttattcacatcggcattcttccagctgacggaactgtacttctctgtcgcgacatttcccccctccttttcctcatagcccttgatggagaaatctcctgtcacgccatctatgccggatatctcgaaacggatcgacaagtcaccggcggcttgcagggtgtgttctacaggtgtcaggatctgcacgcccgtcttctcaccatagaccaaggccgtcgggtagactccgatggggaggcgttgctcggctacttccaattttgtcgtgatgttggttatccagaccgggataatcagcaggtcgttgcggcgcacgaaaccgaagctcgtggtatgctccgtgcgaggacggccttcgatattgacacccagcaggatctctctcgcccccgcgttgccttcggggatgtagcgggtataagtctttatgttgtggccttccgcaccgtccttgatcttcgcaggtacctctttattcgcttcggaagggatgatctcctctttaaataaatccgtttcctctaccgtctctccagtcggaagattcggggccagtcgctccgcaccaccttctccggcagtctccaaatacttgttatttccccaaggcaagagccagatcggtaggcttcccttgcggaggttcatgatgtccaattgttttacggttataggtttgtctaagttgttagttatcttcacttgtaccttgccgatcatgcggatcaagggaatctcgaattcgttagctttcggagcgggttccagcgtatactcctggacgtagctactcatggggataagctttcgagaggctttctcgtctccgaatttaccctttttctcctcattccttgtatcgatactcgttcccgagtccaatatcttcacctccgacagttccgccaaggaatgtgccccggtaattttttgatacaacgatgtaccatcttccagcgactgcaaattggcgaacgcataaaaagagtatttgccgagaggcaacttcatctctacctccgtacgagaatcagaatcagcgatatccggcgtccacgtaccattgctagatgtatatccggccaattcagcgttctcatcatcatacgccaccaccagccagtccgtgatgtctcgctcgtattcatcatcatcttcccaagtaattgtctcgccggctttcgtttgcggtggtcgtgccgagcgggaagtccgcagggtgatggtcacgacacaactgttcgggtcgtcgtcggggagatcgcccccccggtcttcgccgcaggctacgcagagccagcagaggcaaagaccggcggcgaccgccatcaattggttatatagggtataacgtctcatcattcgcgctatttaataaatctcagtttacaatataccatcgttgatacggatcacccagtctttcacctgtatcttgaagcaggcgtaccccacgatcgtagggtcttccggatcaggcccatcgggattatccgggttgtcaggattgtcagggttgtcagggttgtccggtcccggcggatccggaggcgtaggcttatccgggcaatcggggcataccttcggcgtaaggaagaagatgatcgagtactcatcctgccggtccagatactcctgcggggagatacggtgcccctccatcttggtgagaaggaggtaatcgttgaggttcacgttcagcacatccttctcccatccgtggtgacggatgatgaggcggtagttgcgacccgccatcaggcgcatggtgttcatctcggccacggccacgtattgcccgcccacggtagcgccgggagtcgggtcggctcccagctccacgttctccgtataataaggcaggtagtggatggtgggatcttgcagcagggaattgtcgtaatccatatacccgttgtcggccacgatccggaaggagaagttattcacgtccatgtcctcccccatcacgttttgcaacacgacacgtagcttgttggtattcttggcgaggctgatcaccttctcctcgggcatgtcgcgcgtcacggtgaaggtatcgaggctatgccaaagcgggtgcagctcgttgggttgtgtcgtatcgtcctcgcgcaaggtacgtaccttgacgtcttgcgccctctcgacaacccgcgacgcctcggcgggatcgttccacgcgtaactgcccttgtccagcccggcccaagagactacctgataggtacccggctccatgtcgagggcgatggagttccgctcgtccagctcgctcttctcgatccgccgcaggaagaggaagttcccttcttggtcgcagaagaagagcgtaacgaagtctacctcatgctggaaagcgtcggcgaatttcatattatagtcgtacttgaaatacaggcggaactcgcaaagcggcagcgagtcgtcgtgtatccaatcgcaagcgtatagccccacggacaaggcagctacgccaatcaactgtttgcaggtatgaaataaacggttcataatcattttattaagatacacagtaatcctccgcccgtactaccggggatggaggtaaaccatgatgcccattataaggttcttatgatgggcatcgtaaggtggcttggctgggcatcgtaagaagcttacaatgcccatcgtaggaatcccccgaaggggtagggttaaataatgatgtctttgttcgtgcgtttcacccaatctttcacgtagatggtgacgtcgatggtaacatcatccgtctcatccggtttgtccggcgtatccttacccggcgtgtaaggcagcgggtcacctaagccacgcacacccgtcacgtacaattggtacacgttgttacgcacgatacagaactccatcacgcccatcataccatcgttcccgttatcgttatgacggatccagaacttgtaatagctctttccgcctttgtataaggaaacgttgtagaattggtacaaattaccgatctgatccggggtgaaatcattcggatcagtgtaggtatcagggagatgaccaccgtctttctcattttgttcatttctaaattcaaaatagcataggcgcttttttagcccatcagtccagtttgtttcgcccttaatcatgtcactaagatatttcttaaacgcgatctcaaatccgttctgatcagacatggaattaatcaccttttgtacatcagcaaatttcggtaatgttacctcattccagcctttaattaagcctttcaataaattaggatccgaaccctcttccaaattaaatgcgcaagcggcaacagacggaagatctttatagacagaacggacagtcgcaccctcaccgttcttatggactgccaaaaggaatgttttattgtcatctaaaggaacagactcaatagaacccttctcttcattatagaaactgaccgtaaaattattatctggcataaactcagactcgaaaataacgccggtagaataaccatttacttgcgcctcacgatccaacgtgttctccttggtgtacacgacggggtaatatattctatcattcaatcctttataaaaagcttcagtattagcatcaggaatcttagccatattctcaaccctatttaagtctttgttttccggattaaaatagttgatataagagtccttgaattgagcccaaggattattgccttcccccgtaggtacctcttttttgctgatcgacggatccagcacataattataagagccatccgcattatttagcaccgtcatagaccatacttcatcacccaaatatttaaagtcattaccacttttagtataacttccaaccatcgcatccgttaaacttgacccttcgccaaagttctttgtcgctttaggagagacctgcttaaacacgtagcagttacccttccattggttcacgaccttgtaacccgtcaatttgaatgagcctttattctttaccggagagctttcgagtattttatctgtctctaatacagcagcatatcccaagtcgatacgtgcggccatacgctccacgaatacggttgttgtcgccggtttcgtctcatctgtattttccacggaaatgcgaacaagcgaattccctatgccatctacgcctttcatcttgtgcgtagacataatgaagtgatccgctttcgaaacctgattagtgccagtccataaatcctttaaagttactctgtctcgtaagtcacccaaagtagtaataccctctattctatttccggcattaactactgtaaagacttgatacgtatgtccttctgttgtcagttcctcattcatcgtcaccttcatcgtcacttttccggcactgtcatgattaggctcgccacctccactcggatcaacaccggtcttagattcataccaaccctgtccggcaatctctaaacttttatttacgtcatcattaaagaagtccaaggggttagagtcaaatgtattaccgtcatatttcaccaagaagatattaacatcatacaccttaccctcattagcgccatcgaactcttccaagaaaccgttgccgtcctcgccccagccggcaccatcgttattaggattagaaggagttcctcccgccttcgtcaatgcccccttcgacaccgtggagacgttcactgtcatatagactttgccgctatcgccctcaccaccggaattgcctccgttttcgatatcatcggagcaacccgtaaccgccagcaagaaagcggcggccgcgcttaataaataattctttttcatgtttctcatccgtttttatatttgacactcattattatcatcctgcgatcacgactctcgccatcaatcagccagttcctcccgcttcgcagcgatctgcctcaagttctcctccacctgcgaggctacggaaggatcgccggacaacttacccagcagagcctccgcctcgtccaagcggttctccagcatggcgatggccgcctccgccaaggtacgctccgcggaatcggaagtcttcgccagataacgacgagccgattccaagcgacccgcgtcgatcgccgtaagggcggcgttcaggttcgacaccggatcctccggatacatgcgcacggcaatctcgaacacctcgcagtaagcgtcgctacccggttccatcgtctgcgccacccggaacatctcgtttagactcaactgcctagggtccgaatagatcagctcacgggcctcctctaccgtaaacgagcggatcgtgtagcgcaccgcgtaatccgaatggcgcaaggcgggataaatatcgcgcaagagcacccgatacgaggcccccccgttcaacgccttcaacttcgcctcgcggcggtcgtaatccttcggttcgtccgcacggatgatggccagcagctcctccttgtccgcaagcgaggagttctccacccgttcctccaatccggcccagtcctccggctcgaaatccaccgtgaaacgggcctgctcgaagtggtaaaggcctttcacgtattcgatcaacgccttggcgcgatgctcggccaaataagtgttatgcttataggtaccttccggcgatgcgaaacccttgatatatacctccgtgatggtagcgtaaggatcctccttcaccgacgacacggtctcaaggatcttgcgcagctccgagggattatcgcgatactcgggatatatctccgtgcggttcaccgggaagtcgaggaaggcgcttccttccttcacacgctctttcacacgctccgcctccggcgtgacgtaggccaaaagcggccgcaataccacaggctccgcgatccggatcgggaaaagcggcgacttgtcattactcaacgcctcccagccgcaaccgcaaaaatcgactaccagcgacacctccgaacgctccatccacttggcgaaaggaatggaggcatggtaatcgaacgtctgctccttcccattgtaacggcgtaagacaaactccccgttcgccgccgcgtcgcgcccggaccggtcgtactggatctggcggctacgcccgttcacgatcacgggaggcaaagcccttacgctatcgccccgctcgatcagcggcgtacagaccaaactccggttggccgatagcgacaactcgtccaacgctagtttcatatcaattatcaagcgatcgcccacatgctccaccaaccgctccttcacgacgatggcggtagccgtctgctgcgcctgtacgggaatcgtagtacccacacaactggccaaacaggcgatcccaagtatcatccatccttgtagattcttcatttttcagtcctccatcgatttaaaattggtaaatgagattgatcgccgcctgcgtaggcccgaagtaatgcttcttgatcccttcttgcttgcggccgcaattcgcgcagggatacttgtccgacttcaagtacagatagcccacgcccaccgtggcctccaagttccaatggcgagacagcagccacgagtatccataactgataccggctcccgcgccccatccctggtgacgctcgccctctgtacccagccatttgatatcggttacattatataataggtacggagtatgcacgccgaggaaatggccgttaaacgtctcgcaaaaccaatacctcaactccgggtgcagacgcaaatgcttcagtgagcggccataactcccatcatcgttcttgccgctgaacggattcaagcctgcctccaactcaagtgtccaatgacgggcgagataaacttcagcccccaaattaaacgtgacagtagcccaataaggaatattgctcttgatcccaatcatggagcctttcccttcgaccggcaccccctgcgctctcgaaagaaacgggactgccaacaagaatagcatgaaaatcgtcttcttcattctttcttattcattatggttgttaatcttatatcttttcacccttctgcccctcaagacctaacttcctaaaatcaactaacggcaagaatggcccgtggacttatttatggaataaggtttagcgtttcaaaaacgtcagcggagaataaacgttaaacaacattttattgtcgtttatatagtatatcaatagaccacacggaacgtttcagaaaaacatgtacatgttttcctgaaaagacgtacatgttttttggaaaacacgtacatgaaatccaataaatattatggtgtttctatacagctaccaatcaatggcttacatataggcctatccaaacgagcttattgtattatttgtttttgatattcaggaggaatttgtagagtatagaaattcctctttagttgagagagtgaatcaatgaaggtgaatatggttcattttaaagacatagcttcccctaaattccttatttggtgaaaagaacttgacaattttaatgcagaaaagttgtgataataaaatatttattatgtatttttgtgaactaatagggaggaagttactattttaacgctaaaactccttattccataaataagttcacaaaccatccatccttttctctaaaatccgatttacagagcctatcaccttcatgttcgcatgagccaaacgtgatatatccaattcttccagataaaaacgagtcgttttctccgacgagtgccccaacgcctggctgatcaaggccatcggcatatcgcaacgtaaagcttctgatgcccagctatggcgaacaacatacgacgtaaacggattcggtaaccgtaaagtttgcccaatccgtttcagccgggcattatgccgggccaagctacgcttatacctcaaatggtccggattcccgggcggaagaatcgggaacaaatacggcgatccggtcgctcgctgccgatccgcgtatttccggatcaattgcaacatactactggttatctccaaccggatcatacgtcctgtcttatgacggtgatataccaactcattcccccggatattctgcctcgtcaagtacgctatatccacaaaaggcatcccgcaagccataaaactgaatagggaaagatctatcgataattccacttgcgggtcatccgccaccttgatctgggcgatttgctggaacaaagatgcgggaatcgcacgcctcgccgtcatcgcacgccggagtttcaaattctcaaacggataatatgacgcaggaatcaacgactcttggcaagccatattataaagcgcccgcaaactactgatatacgtatttaccgtattagtagctaatccttttccctgaagatacgtgatgaaatctatcaccaacgcacgattcaaatcagccaaacagaaccccgggttcttcacgaatcttaaaaaatgccttacggccacctcatacaactcagctgtcccttctttctttaactgccgtttcatgtctcttcgttttcccatataatccatcaatgagattgctaactttttcttacgtcctcgtttcatactcctttcactaaattatttatactttacacgaacaaattaattcaaattattacttttgttcccgaaaataagaaaataggtaacaattaaaagcataaaagcaacaataaataatatggcaaacaatcgagtcacattcggtagtaaattgggcgtagtactagctaccgtaggatgcgccgtcggactgggaagcgtatggcgctttccttatatgctaggagcgaatggaggtgcggcattcctactggtctacatacttttcatgatattcttgggcattccggtaatgataaccgagtttttcatcggccggcattcccgcagcaatacggtgggttctttcaagaaaatggctcccggtacaaaatggtgctggattgggtacaacggtatcttggccgcatttttgatcttaagttattactcggtcgtctccggttggacgcttgaatatgtttggcaaacgctaagtggccgtttgtatggacagccggatatagactatacggccgattttcaggatttcgcttccaatgtcttccgtccgatcttttggatgggtgcttttatcgggttgactcacttcgtgattgtctcgggcgtagagaaaggcatcgagcgggcctctaagatcatgatgccgcttttattcttgatcttgctgatcatgtgcgtacgttccgtgaccttaccgaacgctgaggccggattgcttttccttttcaagccagactttagcaaattgacttcctcagtggtcttgagcgcactaggacaggctttcttctctttgagtttgggtatgggctgcttgatcacttactcctcttacttcgggaaagatacgaatatgcaggccaccgcttggcaggtgacaatcattaatacgcttgtcgccgtattggccggtatcatgatattcccggcggtattcagtttcggcatcaccccttccgctggtgcggaactcgtgtttatcacgttaccgaacgtatttgggcaattaccgctgagtggcttgtggtcctgtattttttatatcttgctagcgatggcggcacagacttccacgatctctttacatgaggtagctacggcctacgttcttgaggagttccatatgacacgcaagaaagcggctttgatcgtttccttaggagtctttttcttaggaattttcagttctctctcattcggggtgatgaaaggattcacgattggaggcttggcctttttcgacgcactggattacctgaccgccaagatcatgctaccgctgggaggtatgctcacttgtattttcgtaggtacacgtgtcgataaaaaagtattgaaagccgagttgaccaatgaggggactcttaagttccgtcttttcggcgcttacgtattctttatgaaatatgtggccccaatcgccatcggtatcgtattcttgaacgaattagggatcttgagatggattaccggtaaataataccgagaattccttgtcaatagaaacggaacttctacctttgtcggtggaagttccacaaatcaaaacataagactatgaaatggcgtgatttactttatttctccaagggggaaaggcaggctcttaccctactcctttccttaatagcgatggcatggatcgcaattatcgggacggatttctaccgttcccaatttcaaacagttccattggtaaacaccggaatcaaacaagattcctcacggatctattcgaataaaacaccttcaaattccattcggaaagaaaaagaatcccattcgaacgaaactaaaatcccttccgaatggaaatccaaacgcatccgaaaggaatcaaagccccattttccctcttatccccaagcagaaaaatggccgcaaggaacggttgtcgaattaaactcggctgataccaccgcccttaaaatggttccgggaattggtagcgtttttgccaagcggatcattaaatacagggacttactaggaggattttattccgtggaacaactaggagaagtatatggtattgacgaggatcgctatgaagcgatgaaatcgtggttttccgtggacccgtcagttataagtcatctatttgtcaaccaactgtcagctaaagaactggccagtcacccatatgtcagttataaacaagctaggatcatcgagaaaatgatccggaaaaaagggaatttacaaggttgggaggatttatccctattggaagagtttccggagcacgaacaacaacgattacgatattatctttcattccattgatattttcactatgtttgtaacaaaacatattctgtatgatctatctgaagcaagtaaaattactggacccggacttggtagccggcaatcccgaggagctaaagtatccctataaagctccggcggtacgttttacggaatcattcattttccgcaagccggttactttcctcgtgggagagaacggggcgggaaaatccaccctgctggaagcgatgatgagtaaatatgaggagagggatgaggaagaaccgggtatgctctatgacggaaccgaggcctacaagatttacgccaatgtcttacccgagcatattaagctgatcgagacccgaaaaccggaaaagcatttcttcttccgggcagaatccttttttaaccatgcggccgaattggataggcaagcccaactggaattacgtaagtacagcaagatctacgcctataaagcttacggtggcaggagtttattggagcaatcgcacggcgagagctttctcagcgctttcctgaattatgccagccgcaatacattatttatattagacgagccggaagccgcactctctccacaacggcagctggcccttttggtgcgtatccatgaactggtgaataacggttgccaactgattatctccacgcactccccgatcttgatggcttatccgaacgcggacatttatgccatcgatgataccggagcgcacatcaccccgtatgaggaaacagagcattaccagctcactaaatatttcctcacgcatacggagcaaatgatgaaagaactgcttgggtgagattacttctcccaagcatttacgatctcggcaatgtaaacgatatgcgcattgccgttcttctcatcataccaacgagggaaaacgctaggatctaaaaacttagtctcctcgatctcggacttatagaccactttgcattccaacgtaaggcgagcttcctcgaatacaggattaccagcctccgtaaagaacggtgtcaaccccgtagcggccactttatcaatctcccggccggatttagagccacaaatgctatgggctttccggtgctccggtcctaggaaagtaatcgtgaactcatttttagcgtcgataaactcacgggtataacgctccggacgaataaaagcaaacaccaccggacggttccataacactcccacgccgccccaactggcagtcatcatattaaacttctccttatcaccggcgcttaccagcatccactccttaccaatcaactcgataaagttgtctttgatctcattcggattaatcgctttcatatctcattttattttccctcaaagatataaaatattcccttatttaccggtactcattacccccgagtcattatcggcattattcactttcttctgaccagcgctaaatttacggccgaaagagaagttataggaaatcgtcgccacaaacaaacgggaactttccttgatgtaattcgaacggtggaaagaggcgtattggttccagttctcggtctcctgcttatagttatccgtaaacggattaaagacacgcaagccaatcatcaagtctttatgcctataaccgagctggattccttggatattctcacccccactcatcgtctcgcccttaaaccagttccaattcgtcatcaacatatacatgagtgaccaattcttccaagtaacggaaacattcgcgtcgcaccaccagttcgtatatcgatgcgtgtaggtattaccgttactcatataatggttcataccaccattgactgaaaattgcaagatgtccttgatcggaccgacccgcaagttgacggaagcgacaacccgttgccagtttttctgattatcccaagtctggatgatcttattcccttccagatatttctcgtccatgatagcgtccggctgatactcataagcgcccaaggcattcacgtaaaacagacctttgcgaaactcgtaattcaattccgtataataactcatataagacttcaagttaggattaccccgctgtatttgcaaggaatcgatcacttggtcgatagcgctcagctcacccaaagaaggagtcacattccccatcgttgatttcaaacggatggaagattccccgggcaaagcataaaacaaggtcaaccggggactcaccgtataacgttcataatccgcatcctcaccccgttggctataagacgatcgattcacggtcacacccaatgagtaatccagttttttcacctttcccttgaattccgcatatacggaactctccatctgttccatatgcgtcttatagttatgcccattgatataactgttatccgagaaagattggttatggcgtaaaccgccgctcaaccgattaccattcgttaatttcttctcatagatagcctcgccgataatcgagtatttatcaccatccaccacattatttacatcagtcaacaattgttcatgtttactctcttgatagatacgggtcgatttcgtttggttataagtccctaccacgttaaacaccaaagtctggttatgcttcaaatcccgttggtaatacaaatccagcgcaggagcttgataggctgatcccgatagatcgatcatatccactttatcctccggattcgccttattcatcaagactccttgataatcccaatgcggttgatgattattccggtagcggaacgtggcgttaaacatatacttatccggcttttgatagctatagttcacattcaggttatgcatgaacaaacgagcgcgcgaaggttcgcctatttccacacggttcaaggtcgttccattcgctaaatggaactcttcctcgttattccgtttcattccatagaaatcacgaggaccgatccgataagaagcgccccattccgagttcttatgattgatctttccccaagcattatgttcaccccacatggaattgataccttgcgccatgtccagaccaaaactacctcccgtatccggccggcgaacaatataatccagcacgatatcggcattaccataacgtaagcccgggttatcatgatattctatacgaatgatgtccgagggattcaaggccttgatctcatcctgttccaccttcacgccattgatacgcacttggactaccccatttcccgtggccttgatctcactgttcaacaaatccacctgcactctcggtagcatcatctgctgcaacaaatccataccgtttcccgaagccttcatctggcgctccgatgggaagaccacttttttatcggcatggctcgtctgggcagaggcgctaaccgtcaccccgtctaaggataccgcatcatcatttaaggatatttctcccaaagaaatattcttggacaagccttccaaggaaatatactccgtcttaaagcctagactagagacagatagaatataactcccttttttaatcttatttaataaaaaatgccccttcatatccgtagtcgtacccgctacaaaagaagagtccattgtttgcaataccacatttgcaaattccaagatttctttgttgcgagcgtcccgcaccattccctttatctctaagttctgagcaaaagctccctgtaccataccgcctagcagtatgatccaaatcatcatccgtttcatttttatcgtattttttccgaatatagcagggtggcctttcccgcttatcatttgtttctaactataagacgacagccgtttggaaaacgttacaagaaaatgataaaaaaataatatttcgatgaatttgcttcgtagatacgtatctttgtaaccaaacaacagattataaatcatggagctattgaataattggatcaacggagtcaacgatatattatggtcatacatccttattatcatgttattgggatgcgccgtatggtttacgataaaaagtaggttcgtacaattccgcatgattggcgagatgatccgattattaggcgattctgccgggaaaggagaaaaaggggaaaagcatatctcctctttccaagccttcgccgtatctttagccagccgtgtagggaccggaaacctagccggtgtagcgacagccgtagcgatcggcggacccggatccgtattctggatgtggctgatcgctttattgggttcttccagcgcattcgtggaatctacgttagctcaattatataaagaaaaagggaaagactcgttcattggcggtcccgcttactatatgctacatggtttggggttacgatggatgggcgtattatttgccgtattgatttcgataacctttggttttgcctttaattccgtgcaaagcaataccatctgcgcagcttgggaaggcgcttttggcatcgatcatgcttggatcggggcgattcttacggtacttacgttaatcgtcatattcggaggtattcagcgcatcgcgaaagtaagcagtattgtcgtaccggtcatggcattaggatatatagcattggcgttgggaatcgtactgtttaatattacccgcctacccgctgttatagaaaccattctgtcaaacgcttttggttgggaacaggcgataggcggcagtgtcggagcggcgttgatgcaagggattaaacgaggtctattcagtaatgaggccggtatgggatcggcaccgaacgtagcggctacggcgcatgtctcccatccggtcaaacaaggattgatccaagcattaggcgtatttaccgacacgctgattatctgtacctgcacagcgttcatcatcttgtttagcggagcgccattagacggctccatcaatggagtccagctcacgcaacaagctttgagcaacgaggtgggtagcatcggcagtacgtttgtcgctttagcgatccttttgttcgcgttcagtagtattatcggtaattactattacggagaagcgaatattcgttttatcacgtccaagagaagtgtcttatttatttaccgtatattagtcggtggaatggtcatgttcggtgcgttggctagtttagacttggcttggagcctagcagacgtgaccatgggactgatgacgatctgtaatttgatcgcgatctcattgttgagccatcaggcgttcctattattacaggattacgtagcccaaaagaaagcgggtattaaaagccctgtattcgataagaacaagatacccgagttgaaagacaaagcgcagtgttggtgatcagacaaacgtattgaagtatgataaaaagcaagatgataagcttttacatagcggtcatgatgatatggacctgtacggtaaaagctcaagatgataataaatccctaatccacaaaattggattcgacgtacgtccctcgtatgtcgccccgactagcaaattcctaaaagatgatggctatggaaacgggcttactttacgtaaggcggcttcattccatttgaaatacgggttccaactgaatcctaactctaaggagggccagctctatccgcacacttaccaaggaataggcatctcttataatacctttggcaatcggcaggaagtaggtaatccttgggcggcgtatgttttccaaagttcccgcatcgccaagatctcttcccggctatccttcgattatgaatggaatttcggagcctcattcgggtggcatccgtatgatgataacaataattaccgtaataagatcatcggttctaagatcaatgcctatatcaatctgggatttttcctcaacgcgaaactatcccgttattgcaacctgctcgtcggggcggatttaacgcactactcaaacggaaatactcatcttccgaatgcgggattgaatacgattggcggccggatcggactcgtctacacgctcaatcctatcgaggaaagccatcatgagataggtaccgcacgttccttgccggcaaatcaattatacctctccagcttttggcaacgtgtcagttacgatgtcatcctatacggtgcgacccgtgctaagggggttatgctaggtgatgaggcccatatttttccaggtcagttcggcatccttggattcaacctcaacccgatgtacaaattcaaccggttcctaaaagcaggtatctccctagacggccaatatgacgaaagcgcaaatatttattccgacgagatcatccaagtcggcgaagaaccccgattctaccgcccgcccctacacgagcaaatcggtatcggcctctccgcccgtggcgagttcacgatgccattcttctcgatcaatataggagtcggacataatttattctacaacaaaggcgacctgaaaggattataccagatcctagccctcaaggtatcggttacacgaaatttattcctgcatgtcggataccaactgcacaagttccataatccgaataacttgatgttgggagttgggtataggttccataataaataaaagataatatcccgcttgctaagattataaagttcaatcgttcataaaatctaagaaaacatatcgatcaaacttctttttgaaagtaaaattgaagctgtgcctttcatctttacttgtaagtggtatagctctatatcctttttttctataataagcttcgtagagaagaagttgtctcccgataccgtaacaatagaatcttctaacccttctatttccgctttcaataatccatactctgatgaggcgtacccttcaaactcaatatcggccgacatacctttatgaactttcgtgataaaccggtaaggtacaagtgccgtcacttccacataccgctcatctacctgtgtaacaaaaacactcaccgtcacattctccggataaggtataaagcatgctaccaacgctaaacagacaagcactgttgtcaacatcccgatgccgtcacgcacgattccacctggagccttaccaattatctcctgtaccttctcactacgcaactctatattatcatactctgccatacgcatatacctttctcattctcaagaccctaattccaattgattctccactaaattataataagcaccacgtttttcacacaatgatttgtgattcccaacctcaacgattttcccgttatcaatcacaatgatctgatccgcatttttcacggtactcagccgatgagcgacaacaactacggtcttacctctataaaaatcattcaagttccccacgataacccgctcgttctcggcatccaacgcattagtggcctcatccaagaaaatatattccggatttttataaacagccctagctatcaagatacgttgtttctgtccttgactaagcccaacaccatccggaccgatttgtgtattgtatttcaatggcagtctcataataaaactttttatattcgatatatctacggcccggagtaaccgccccgcatcaatctctccatcatccacggcaatatttcgtgcgatcgattcagaaaaaacaaccccatcctgcataacgacaccgcattgacgccgccaccatttcagattcaactcactaattggggtattcccgatacagatcttccctcctgataccggataataacctaataacaatttaatcaacgtagttttaccactgccactggtaccgacaatagcggtcaccttccctccgggaaccgtaaaactcacatcatctatcgtctttcggagactgtgcggatcatacttaaaatcgacattccgaaaagacaaatcccggttatcatccggataagtagccaaagagtcggaatggtcctcctcattcatttgcgcatggatctcattgatacgatccaagctgatcttcacatcttgagacgcataaatgaagttcatcaattgttcaaccggcctgttcaactgcccaataatatattgtaccgccagcatcatacccaaggtcatctgtccctccaacaccgaggtagctgccaaaatcgttatcaagatattcttcacttgggtaatacatactccaccggcctcttgtgcctgtttcaacttcaagctacgcatttgcaaatgaaataatccagcctgtacatcctcccactcccaacggcgacgttgctcgcaatcctgcaacttgatctcctgcatagtggtgatgaactggtaagtcttattattattctccgcctgtttctcaaatagttcataatccagcaccttacgcttacgcaagaaaaatgcgatccatacgccgtacaacacgctccccatcacgaaaatcagaaatatcatcttatcatatatcaatagtacgatcccgaaaacaacaaatgtcaaaaacgagaacaaaaccgtcaatgactgagttgtgagaaattgctccacccgcttatgatcacccatccgttgtatcaagtctcccatcaactttgtatcgaaaaaacccatcgggagctttagtaacttaataaagaaatccgagataagggatatattgatgcgcatgctgatatggagcaagatccatcgctggataaaatccaagatcgtttggctgaaaataagggtaagttgtccaagcaagattagccagataaagctcaaatccttatgtgtgatacccacatcaacaatcgcttgtgtcaagaagggaaagattagctgcaaaacgcagcctacaatcaaccctaagataatctgtccgaaataatatttgaattgcttgaaataaccaagcaaaaaagcgaaagtacgttttcccgcagcctgagtagattcttgttgataaaaagcaggcgtaggctgtatgatcatggcaactcccttatcctctcctttcgagcggaccgttatccaacgatccacaaaatccttctcctgatattgcatcagaccatttcccgggtccgccacgtagtaaacacttttcctcccttttctggatttgatcttgtaaagaactacaaaatgattctggttccaatgtaagatcacaggtaactcaactttcgctaactgatcgatagacatttttccgcaagttgttttcaaacctaattcacctgccgcctcgctaatgcccagtaaggatacaccgtccttactggcaaagcatatcttagagagagaatctatcgaataattcttccccaaaaaggcacaaatcatccgtaagcatgcgataccacactgcatcgcatcgtgttgtcgatagaaagggaaactacgcataagaatatttatttacaatctgtttataacgtcttgtcctgctcccgaacctttgtatttatttcgtcccatattaaatttaaaccgaactgttagcctgacagactcactatccaatttagctctttgataggcagtattgataccactatacaaatctatattctgtcggcttaaatgccctacatcaaaccattggagattaaagctcaaacgatcctgcaaaaatgatttccgtaaacttaaatcaatttcccctgtctgatttaatatataattttgtgatgcaccttttgtctgataagagaaatcagcacgcaccacaaaaccttttggcaaactaaacgcattattgaagttaaacatcaacatcggcttattcatagctttgaaaccgtccatccaaggagtatcgaaccattgtttcctaagccctatatatgccattggctcccaaagaccaattttaggagataaagagagggatgcgttcaaacaatccagctgtccttcgttacgataggttacgaacactattcttggatccttatcataaggatctgccacattcaatattacatcgttgaatcgttgataatccaaagatagttgaacccactgataagataaatccaatctcaaactatgaataatctccggctgtaactttggatttccacctttataggaaaaacgatttatatatacaatattattacttaaatccccatagtccggacgatggattttctctgaatagctcaactggctttgaactcgtcctataggataagacaaagaaacaaaaggaaacaagttatcataagtccgcctaagatctgaatctccggaaaacttatcttggaaagaataattcacatgctcatatcgaactcccgcagaaacatccagatttccccaagaacgagtataatccaagaaagccgtttccgtcttctcctttgccacattacccgtacttggtaatatagcttcctcatttttataatactcgttttttttcatgcttgcaaattcacctccaaatgagaaatcccccccccataaaggatgggataagattagtttagcagcaaataaatgaactgaattatctgaaaaagaacaaattgcgcgatcatcaaaatgtaagctactctcctctgcataatcctctgcataatctttattccataataaatctgcgttaaaatcaatatttaatttcccgatcattcctgtataataagcatttaattgttgtttaggacctctacgttcatttgtccgactgttattctcccagtagtcgtactgactctcattcgcatatacctgactcctcacaaaagacactttcgagtttttaggcatagcattgattgaatagcggactcctgccgaatgcctttcattaaactgattgttaatcccaatattcccgtcataaatatgccgcttataatccgtatcaaacgtataattttgtcgccacaacgtatctaagcatgtaatctgctctaacgtactttcttgataaaaattccgcaatgtataagcgaatcccccaaataggtctaatccatttttgctatatttgagattaaattgctccatgagtccggacttatgcgactgttccacacgggaacgtacatccagccccaacccttcaccaaccggacgagccgtccgaattcgtataaccgctttaacacttgcatcatattggactcctggattattcaacacttcaaccctagcaatattctccgatccaagcctttccagttctgacaaatcacgaaccaagcgtccattcaaataaatagaaggtgtaccttttccaaacacggaataggcaccatctttaccttgtacaccgggtatatgattcaacacatcactagctgttcctattttactcagcaaggaattttgtacatttgtaattaacttcccatttttcaattcatatacaggacgatgagctataaccaccgcttctcccaacaccaatgattgctctgggatcacgataacgcctagggaaccaatcgtacaatttctaaaaacagtttggaaaccaacagatgatatcttaagtaaataattatcatcagacggaaccggtataagaaaacctccatccttatcacttacccctccatccacaaaaaaagaatctgtagtcataacaaccacattcgcataacttaatggggcattattgttatctttcaaagtacctgagattgcctgagcccctaaagtgaacacagtcatccaccaacctgcaaaaaatagcaaaaaccatcttttttctttcccacccattttcatattgtattatctaatcattattattaaatctctaaagcgtttcgcttgcaataagagacagaggaagtaaatttcttgccctcaaagacgggcttaagtctacaatttttcaatgcacattgttttttaaactgacattttggacaatcatccaaatcattcagtcgagttattcctctgaatctatccaatttagaagatctccaaatatcatctatactttcatgtaacaaatttccaatgacatattcctcatgatcaaaagcataaaaacatggatatatatcaagattttcatccatagccaaaatactattccccgctgaacaagcgataatatcactcttttctttttctaccaaagaaaggtcgtcggacaattcaagtctacgaccatatttcttatgggcttcattatacactctatatacttcttgactctcatcctcactcaaaaacaaatttttattatcaccagctcttcctacgggacgcaaacaattcaagaacaagacctctgctctcaagaaatctaatgtaaaagaaatcatatcccgtatttgataaaagtttcttttattaatagagcaagttattccaaatttaacacctgcatctctcaatctcaatagttgccgagaaattacatcaaaagctccctttcccctagtgaaatcatgagtctcactatccaatccatccaatgaaatccctaaatggatatcacccaaccggaggatttcaatatctctatcctttattagcataccattagtcaaaacaattgtctcaaaatgccttttagataattcaagaagaatctgatcaaaattaggtaccgtgaaaggttctcctcccgttattttcaaagttttcaaattaatcctatcaaattcactgaaaatgcgggaaaatacatctataccatattctcgtatcccaaattttggagaagctccttcaaaacaatgtttgcaagctaagttgcaatgtttagtaataacaaaatctattcgtcctggacttatttctgtcaatggtgacaaattcttcttatctttataaaaatcaggtatacaaaatgattcctttgtcggaactaataagtctatgaactccggatttctcagaaaaaccaaaaaatcatccatattgatacccatattctcgaatttttctttcacgtatcccaaagaaagggacgaatgtctaaataaatttagaataaagaatagcttgtatgagagttcataacgtttttgaatagacttattatataatgaatactgatcatcaagcccttttcttagtacataattttgatttatagtcaattcatctttcataatttattctatataaaattccatggattcaaagcacgttcctcaacccatggaatttaattaatatttacatgtattatttccacatacgccataaaatggattacaaattacgactccttttcgtcatcttttttcccattacaacagttgccgatgacagacccatcaccatccttcgcgacctcaaactctgttttcagaattctggccttcccgcctttaagcaattctaaagactcattgtcgattgcttcaaaaagctctacagtcatgtgttttgtttccatgtctcttcaaattagattttcgtcctactcataagcttttcggaattcgctcctatgttatacagataggttctgtttctatttataaattaccggtaaatcaaaaatcacctaaataattttggctcttaatcggatagcctatgtcatcaataacatgatcttctatccatatccattctccatccacatttacccattcccctccacgaatctgagataactcaaattctgtaagttttttaaatttcaaattttccatattctctgttctttgttcataatgtaaaggaagaggttttcaaacaaatcatttataacgaaaacataatatttatatcattattttcaaactctttggttatatttgcgtaatcaaatcaattataagatgaaaaaattctattatataacactaatagccatgactgcaattacctgtatacaaataggttacacgaataacctatataataattataagaaaaaagaaataatcatgataaataatcatttactgatcgctattgacgaggagcttcatctacgaaaattagttcctaaatcaactgataaacgtcttataacatataaaagattagaagacatgactccccaagaaagggatagcctattaaagataaccaaaccaggggatacgatcaatatagatcaagccagaacacagaatataggcacaagtgttggagaaatgatagggcagctacgtcaagatatggcctttagcgaaggaaatcctttaaacttagatacccttaaccatatcttctctgattctatccccccaaatttagcctatcgtatcgtacaatatgataaggatacgttagccatcgattctgtcgggtatagcggaaagaaatcgtggaattatgtctcagagctatttccaataggaaccaagggacatgtattcttacaggttaaagcggccattccctggtttgaatttgtctggcatcaattatgggatttgatcacctctttatgtatcatgttggttactttcatatgtttggccatccaattgatagagattaaacggcagaatgagctattacgtaagcgaaaagctacaataaacggtaccatccacgacttaaagtccccactaaatagcgtggtcacgatgttaagctggttcaaggccaccgagaatgatccgcaaaagagaaaaatgatagagaccgggctttccagcataaagcatctggtatatacgatcgaatcgctgctggtaatcgcccggaaagacgagcaccggatcgttctcaataaaacgagggtggatgtcccgaagctagtggagaaaaacaaacaggaattggcatttctctatccggagaaatacgaacatatccatatcataaatcaattgccggagggcttcaccgtaccggccgacaagatgtacatagacaacgtcatacggaacctgctggagaacgccttgaaatactcggacgaggaggtggaagtgacggtgacaatggagacaaaggagcagatactcgccgtttccgtgaaagacaatggctggggaatcgctcctcaacaccagaaaaagttgttcacccaattctaccaagttcctcgcgacgaggataaactccgaagaggatatggaatcggcttggcgcaagccaaatatattatagaggagcatcaaggggagataaaggtaagcagcgaggaaaataaaggtagcctattcacctttacggtcccacttcaataaatcaagaaaaacaatcgatcatgggaaaaataaaagtcttattcatcgatgatgatatagcattgggaaatgtcgttacggtagcattggatagtcttggctatgagacttattaccagacatcccttgtagccatccgatctgtcattaaagaattatgtccggatatcctcatactggatgtagagatcgggcaaaagaatggtatcgaagctacacccgaattgaggcttatcttaccggatatacccatccttttcgtatcgtcgcataccgaaagctcttttgtgacgcaggcattggatgccggagggatcgcatatctgaagaaacctttcgagattgatgagttagtggcttatatcaagagacatacaaatacctcatcgcatgcttccttcctacagataggacagctcactctctatacgcaagactatatcctgatgaaaggagaacaaatcgtaaagaggctcaccctatccgagggtaaattattgacactccttgccaatcatccggatgaaaccatcagccgacaagaaatggaacaggaactctgggaggatggctatacgaacgaacagagcttgaataactttatagcgaaactccgcaagtacctgtccgaagacgataccctggaactaaccactatacccaaggtaggctacaggctggcaacaaaacataagcccgggatttgagcataagttccataatcctcgctagccactcatcggataatcgggagaaaacgcatcatacattttgtatgatacattttgtatgatattttcgttatctttgtaagcaaacaaaagcgtataagatatggcaacttctaaagtaaatccatttcctacaacaggttatatggggagagaatatttttgcgaccgggaagaggaactttcatccttgagaaaattcgtggaaaacggaatgatatctatgcgagtcagtccataaaggaatttacggaaagtttgtcacaagccattttgcagcaaatcccggaacagaaaagtatcgggaaacgctttctggatctactgaaaggtttccatccgatcctttcttacgatgcgctaacaggacaaccggaaatcagttttgagtttaccgaacaaaaaggcgccgagaaaaccttggcggccattttccagtttctggaaacccaagatcgaagaatattgatcgctatcgacgagtttcaacaaatagccaactacccggaaaccaatacggaagcattattacgctcctatatccagcaactgaagaatgtacggtttattttcagcggcagcaacaagcatatgatgaacgaactgttcaacagtgccaaacgcccgttcttctccagtacgcaaatgatgccgctagccgccattcccaataacttttacgctactttcatcaagaataaatttacagagtcaaatcgtgagattagtgacgaagccattcattttcttctcacgtggacacgcactcatacttattatacccaaacattatgtaatcatttatatgcgtctttcttaaaacgcatccaagaagaagatgtaagaaacatttgtagcgacctcttgtcttcccaacaagctacctatatccaatacagacgattgctaagcccggtacaatggcaattgctgatagccatcgcgaaagaagagcgagtgttccagccccagtctaaagcctttctcgccaaatacaagatcggcacacccgctaattccaagcgggcgctagaggctttgttggacaaagagatgatcttcaaggaagaggatttgcgaaatagctggtatcaagtgtatgacgtattcttgtcccgatggctgcaactgacgttttaatcatagattaagctaaacaaccgttccggagcgaacacctcattcgccacgtctaggatttgctcggcggtcagtttctcgatctgggcaaaaacctcggggagagtatcgtaacggttgtaatggaggtagctttttcctaagccaaggaaaaggccctcccggttatcgcccgacacacccagttgaccgattacctgcttcttggcggcggctaattgagtggcggacagttttacgtcacgtaaacgggctaattccttatgcaccaaacgcatcgctttctcacggttcttcgggtctgtcccgaaatagatactggctagtccggtatcggtataagaggttatattggattctacgttatagaccaagccatgcttttcccgcaaggagacattcaagcggttattcatgcccggaccacccaaaatattattcaacaaaaataaaggaatgcgctttttatcgtgcatactgaaagcccggccaccgatcagtacatgggcttgatgggtatctttatggatctggcgtacgcaagcctcgatggggtccggagctttccggatccgttcagccatagggaaagagatatcgcttaaagcggattccgctgatttcaagatcttcttgaagtcttttcgtcccatcgagaagaacaccatattctccggggcgtagaaacgacgcatgaaagaacgaccggactcggagtcaaagcgaagaagagattcctcatcccctaagatattatgcccgagggcatgacccttataaagcaagttctcaaactcgtcgaatataagttccgaaggactatcctcatacgaattgatctcatccaagatgacatctacctccttctcgatctcctgtttggggaattgggaatggaaaaccagatcggtcaatagctcaaacgcccggccgaaatcctcctccataaaaatggaataaacaaaggtctcttccttcgtagtataggcattcaactcccctcctacgttctccatacggttcaggatatgccacgctttccgtttctccgtacctttgaagatcatgtgttcaacgaaatgcgccaagccaaactcatcctcgttctcatcccgtgtaccggcgttcacggcgaaaccgcagtaagagaccggggaattaaccgggagatgtaccatgcgaagtccattcggcaatgtatgagcgatataatccattttccttcttgtttgtatcagcccgcaaaggtacgaaagactttccggaaaaacatgtacgtctttttcaaaaaacatgtacgtgtttccggaaaaagacgtacgtgtttttttcgatctatttgcctccttggaaaaaatacctacatttgtgtaaattaaacagataaggctatgggaaatatcgtcagaaaattaccgataggcatacagagttttgacaaactacgtacagagaactatttgtatgttgacaagaccgagttcatttatcaaatggcataccaaggtgtcccttatttcctgagccgcccccggcgattcggcaagagcctgctgctttctaccttcaaggcttacttcgagggaaagaaagagttgttcaagggattggccatagagaaactggagaccgagtggaaagagcatccggtgcttcatttcagcctcaacgccgagttgtacgatagccgcaaggcattggagaatatgctggaacgccagttgagggaatgggaaaaaatatatgataccggaggagagggtatcacctattccggacggttcatgaccatcatacgaagggcggcggagataaccggaaggaaggtggtcgtactgatcgacgagtacgataagccattacttaggaacctgcacaacgaagagctacagaacgagttccgggaattattgaccgccttctatacggtcttgaaagatgccgatccttggctgcgcttcgtattcataaccggtgtcaccaagttcgcgcaagtcggcattttcagcaacctgaatcatttgaacgacatcagcctagccccgcaatacgcggccctttgtggcatgacattgcccgagatcgaggcaactttccagccggagcttcatgccttggccgaggcgaataagctttcatacgaaggtaccatcgagaaaattacacgccggtacgacggctaccattttgatttccgcagcggtatcgccctttataacccgtttagcgtattgaacgtgttgagtaaacaggtcttttacgactattggtttgcttccggtaccccgacattcttggcggagatgttacggaaaacgaattacgatatacgggagctggacgggatagaggtatccgaggtatccctttcggacgatcgggcgaacatcaataatcccgtgcccatgatttatcaaagcggatatttgacaatcaaaagctacgatgaacgtttccggttatatacgttaggatacccgaatgaggaagttaaatatggatttttgaattttgtcgcctccatgtatgcgcatttaccggaaaccgagactcctttttatatcgggaagttcatccaagagctggagaacggaaacgccgaggctttcctcacccgcctaaaggctttcttcgccgatatcccttacgagttgaacgaccggaccgagcgtcattaccaagtggtcttctacatcgtattcaagctactaggacaattcaccgaggccgaagtacgttcggcccaaggacgtgccgatgccattgtaaaaactcctcgctacatctacgtattcgagttcaagctgaaaggtacggccgaggaggcgattcggcaaatcgacgatcgaggctatctgattccttatacggccgacgaacgggaagtagtcaaagtgggggtcgctttcgacgcagccactcgcaacttaggtgaatggctgattgaaaaaacattgtaattctatgagaaacatgaaaataataatctgtttactaacaatcacttccttggttcttactgcttgtggaggaggaagtaatgatatagagaaagcgaaaagcgtagcgaccacggaacatttaaagcgatacaccgaggccatctcgcatgactcctgccaaggccgtaaaccattctcggaaggggccgaccgtgcggtgaactatatcgctcaccaaatgaaagaggttgggctgaaacccatcaacggcgattcttatttccaacaggttaatatcatatcctcacgcacacgatgtccggatccgatggtcctaaagaccccgaaagggaaaatccccttagattggttggaaggttatactgctttctccgcacggatcgagcctgagatcgatatcgataacgccgagctggtattcgccggctatgggatcgtagcccccgagtatgggaaaaatgatttcgagggaatcgagaacccgcgggataaagtagcggtcgttatcgtaaatgacccgggactcggaagcgacaacacggattattttaacggtgatatcatgacctattacggccgttggatgtataaattcgaggagggcgcccgacagggattaaaaggagtcttgatcatccatgaagaccggggagcgggctacccttggtcggtcgtacgagcttccgcccaatctaaaatgtatgtggacagcgatagcgatgcttatcattgcccgctaaacggctggatccaattcaatgccgccaagcaattgctagccgataatggctacgactttgaccaactaatcgagcaatctaaatcgccggacttcaagcccatctccttgaaatctacggtaaccgtctcgatgaggaacaccttcgaccgccagcaaagccccaatgtaatcggttatattcccggtagcgggaacacggatgagagtgttatttacctaggccattgggaccatctaggctatggagcaccgatcaacggcgacagtatcatcaacggcgctaccgataacgccgtagccatcgcatggatgctcgagatggcacgttgtttcaatgccttgaaagagaaaccccgccggaatatcgtcttcctctcccctacttgcgaggagaccggattcctcggtacgaaatactatgtggagcacccgttgttcccgatcgataagatagccgccgtaatcaatctggatgtcttcccgctatggggcgagaacaacgatgtcacgatcaccggatacggcaactccgagctggatgataccctagccgagctagcgaagaaatacaaccgttacatcatgcccgaccccgacgcttacaacgggatgttctatcgctccgaccatttccctttcgtacaaaaaggcatcccggccatgttcgccaaaggctggaacgacaaccgcaaacagggtaaggagtgggccaaagagcatatcgcacgctattgggcggaaacttaccacaaaccgaccgaccagacccatcccgacacggatgattacagtggtctgttacaagaagtacaattattcttcgacctcggttataaactggcgcaagataccggatacccgaaatggaagccgaagtccgaattcgcaaacgtcttaaaaagataaattgtctgaaatagatgatgccaatatcagtaaatataaatactttcgcgatcgttattcaggcaggaatgccgtaaaacaatcaatcaacaatatggtaaacgaaaatatcacctctttattggagcaggaagcggaagcggttcgcaacatacccgttacgcccggatatgaggaagcggtatcgcttatagtgaaacatgtacacgacctaggtggaaaactgatcatgagtggaatgggtaaagccgggcaaatcgccttgaatatcgctaccacctttagctcgaccggtacacctgcttttttcttacatcccagcgaggcacaacacggagatctgggaatcgtatgcaagaacgatatcatgttattgatctccaactcaggaaagacacgtgaactggtggaattggtagatctcacgaggggtttggtgccagacatgaaatttatcgttatcaccagtaacccggatagtcctctagccgccgaggcgaacgtatgcctgttgaccggcgctcccaaggaagtttgcccgttaggccttacgccgactacctccacgaccgtcatgacggtaataggcgatatcctcgtggtcggaaccatgaagcgtatccatttcaccaacaaggattacgccaagcgccatcacgggggctacttaggctccaagagccgtgagctaagcaagaacgaataacaaaccagtatatagatcatgagaaaagtctttggtataggagaaaccatcctcgatatcatttttaggaacgaccagccacagaaggccgttcccggtggttccgttttcaacggattgatatcattaggtcgattgaatgtccccgtatcctttatcagcgagctgggcaacgaccgggttggcgacatgattcgggatttcatggaagataaccacatcacgaccgagttcgtagaccgtttccccgatgggaaaagtcctatatcactcgcttttctggacgacgataagaacgctaattatatcttctacaaggattacccggcgcaacggctggaggtgcccctgcctaagatcgagaaagacgatattttcgtgtttggctcttattattccctgaacccggtcttgcggactcgtatggtagaatttctgcaatacgcccaagaacggaaagcgatcatctattacgatcccaattttcgcaaggcacacgctcatgaggcgatccgcctcatgcctaccgtactggaaaatctggaattcgccgacatcgtccggggctcggacgaggacttccagaacctttatggcaagagcgacgcacaggaggtttacaaagagcatattcagttttattgtgatcgtttcttaacaactcacggggcaaacggagtcaatctccacacccgtaatttcacacgacatttcgattccccgcaaatccagccgcttagtaccatcggcgccggcgacaattttaacgcgggtattatctacggacttctaaagtatgacgtacgccatgccgaccttccctctctggatcaggatacttggggaaaaatcatccgctgcggaatggacctcgcctccgaggtttgccaaagctatgataattatatatccaaggagttcgcggcgaagtatgttagtcagtcttaaatatcattaatgaagaagcgggaaaaacttgttttactatctttgtaaggaaagcttattataatagaagacaatgttaggaaagattctctctctattcgccagtgtgatcctgttagtgggttgttcctctaacgcgcccgacatacgagctatttgcctacgtgatgacatcggaaattacgtgataaaatgggaaaccgatccggtaatggaggggattgtcaagatgaccgtgtccgacaacccggatcttttcaccaacgagtccccgatcatttacgccaacatcaaggatggcgtggctacttacatcacgaacgataatatatcacgtaagtatttccgcctttcttttaatgataaatacgcacggatcatcggggcacgctcggcggttatggatagtgtacagaatttccgggatctaggcggttatacctctacaaacgggaagacggtgaaatggggcaaggtatttcgctccggcgagttaagcagcttgagcgaatgggactccatccgattggataatctagggatcaagaccatcatcgacctccgtacgaaccaagaaaccctcaccgcccctatcaaatatacgaaagcaaatatcctgcaaatccctatctcggtcggcaagatcgccgatgccccccaacgtgttatcgagggacgaatgcggaaaggagacgccggggtatatatggaagacgagtacctgcaattcgtgacagataacaccgatcagttcgccaaggtactggaacagttccagaacgaggataattaccccattctcatcagttgttcctacggaaaggatcgtaccgggtttctcaccgccatgttactcgccgccttggatattccccgagatgccatcatggaagactacttgacatccaatcaatatatcgatacgagtcatttagctgatatcgtgaaacatctctccacagacgcccaagaaagcattacggtattccttacggccaacgaggggctcatggacctagctttccataaaatcaagaaagagtacggttccaccgagaaatatttgtcgaaaggattacgtcttactgataagaaacgtgaaaggctaaaagatatattactttattgatatgaatccgaattatttacgtacctttgcggccactgaatattatcatatatacacaatcgcattttgaaaacatttgaagaattaggagttgccgcaccgatattaaaggcaattcaagagatgggctatgaatcgcccatgcccgtacaggaagaagtgattcctttcttactgggagaagataacgacgtaatcgcattggcacaaacaggaaccggtaagacagccgcttacggcctgccgatcctgcaaaagatcaatgtctctcaatatcaacctcaagcgcttatcctttgtccgacacgcgagctttgcctacagatagcggacgatttgaacgattattctaaatacatcgataacctgaaggttctccctgtatacggaggttccagtatagagagccagatcaaggcactgaagagaggcgtacacgtggtagtggctaccccgggacgtttgatcgacttgatgaaccgcaagacggttgatttaagcaacgtaaagaacgtcatcctcgacgaggcggacgagatgttgaacatgggtttcaccgacagtatcaacgagatcttggcggctataccggaaaaccgaaatatgctgctcttctccgctaccatgccgaaagagatcgcttctatcaccaagaaatacatgaaggacccgaaagagatcgtcattggcaggaagaacgagggaaacaaaaatatccgcgatatctattacatggttcgtgcgcaggataaatatctcgcgttgaaacgtctagccgattattacccgaacatctacggtatcatcttctgccgtacccgtaaggagacacaggagatcgccgataaattgattcaagacggttataacgccgactccttgcacggcgagctgagccaagcgcaacgtgactacgtgatgcagaagttccgtatcaagaatatccagttattggtcgctacggacgtagccgcacgtggtttggacgtggatgacttaacccatgtaatcaattacggtctgccggatgaggtagaatcttatacccaccgccgcggacgtacgggccgtgcgggaaaaacgggtatcgctatctctatctgccacgtaagggaaaaaggcaagattcgcgagatcgaacggatcatcaacaagaaattcgacaggggcgagatgcctaccggtgagcaaatctgtgagaagcaattgttcaacttggtagaccaaatcgagaaagtgaaagtgaacgaggaggaaatcgccagtttgatgccttctatctaccgtaaattggaatggctggataaggaagatatcatcaaacgtgtcgtatccttggagttcaaccggatgatcgactattataaagataacgatgatatcgaggttgtagacgagaacgctccccgagagagaggtaaacggggtggcagaggcgaagcggaagaaggttacacccgtttctttatcaacttcggaaagacagacgagcttacgcctcctcaacttatcgagttagtcaacaagtgcgtaccaggcaaggttcgtatcggtcgtatcgacttacgtgataatttctcattctttgaggtagaagagggagaagccaaccgtgtcatggactcgatgaacggcttcgaggtagacggacgacgtatctccgtagaaccggcgcaagcgaaaggcgagggaggaaaaggtggacgtagtcctcgtggaggcagtcgtggaggcaatggcttccgagacagacgggatagcggtagaggaggcagagacagccgccgggaaagtgaccgtggagaccgtggcggcagacgttccagccgtagtgacgacaaaccgaagcgcaaattctatgaggacactcctcgtagcaggaagaaacgcaagtaacatacaacttatacataatttatcaaagaagcgtggttcgtttattacggatcacgcttcttttattgtatatttacagccggaaaatcacagtcaatcacaaattcaaagataagtcacatgaagacactgcttaaacatctttcctgcttttgcctcttctttatattcggagcaaactatgccatagcgcaaaactaccaacatgattttgaccaagtcgtaaagaaggtagatgacctcctatggtacgagaaagtgggcgacatcgcccatatcgacaaagtctacctttgcggccccgcccgctggaaagaggcgaatcctaccgggatgagcgccggaaacgaactgaagttctggacttatatcttcatccctaaaagtgtggatcccgacaagaaatatcctttgatcgttctcccgcatagtggcgtacacgcagatttcaacacgtattacgcccatatcgtccgggaactgatcgcccaggaatacatcgtggtctccgctgaataccggggtagcacggggtatggcaaggctacttacgataatatcgattacggaggattggaaaacgaggatgtctacgtcagccgtaattatatggtagagaatttcgatatcgtagatgccaatcgtatcggcatcatgggatggagccacggcgggatgatcacgctaatgaacctcatgacctatccgggcaaatataagtgcggtttcgccggagtaccggtaagcgacgtgatcatgcgcatgggatattccaccgatgattatcggaaaatcttctccgacgagggccatattgggaagactccccgggaggatatggcggaatacaaacgccgctcaccggtctggcacgcggaaaaactacaagatcccctgctcatccataccaatactagcgacgatgacgtgaacgtagtggaagtagagcatatgatacgcgctctcaaggccgaaggaaagaagttcgactacaaaatattcgaccgtgctcccggtgcccatagcttcgaccggaccgacacgaaacaagcttccgagatacgactcggcatctaccagttcctcgccaagcatctaaaacccaataagccattcaaatccgtaaaagacgtacgaaaagcggcctacaaatttaattgatacaaacatctaaataacacaagaaagatgaagaaactttttacctatgttcttatgctttgcgccagcctatccgtttcggtagcgcaacaaatccagtatccggagccgatcttgaacccggagagttgtacgagtatcatggtcggcaaaaaagcctcggcggatggctccgtgatgactagccacacctgcgatagcaattaccgcacttggatggatatcgtaccttccgcctcgtacgatcacgatacgacaaccacggtctataccggacgtatgcataccgaatatgccgagggaacccgggggatgattgcgaaaggaacactgcccgaagcgcggtctacgtatcaattcctcaacacggcctatccttgcctgaacgagaagcaactaggcatcggggaaacaacaatcaccggccggaaagcccttgtcaacaagaaaggtatgttcatgatcgaggaacttcagcgaatcgtcttacaacgttgcacgaccgcccgtgatgccatccgtgtgatgggcgagttgatcgagaaatacggatatggcgactggggcgagtgccttacgatagcggatccaaaagaggtatggcatttcgaggtcttcggcgagggtccggataagatcggtggcgtatgggcggcgatccgtatccccgacgatcatgtaggcgtatcggcgaatatcccgcgtatctctaaggtcgatccgaaagatacggacaattgcatggcttccgccaacgtattcgaggtagccaagcgcatgggcttctgggacggaaagaaaccgttccgcttctgggaagcatatggaggcggaaattattccggtgagatgaaatccttcagtatccgtgagttctttatattgaataaattagcgccttccttacgtttatcgtatgacgcggaagaacttcccatcagcgtaaagccggaccggcaagtatccgtaacggatgtgatggctctcctctccgaaacgtacgagggtacggaatacgatatgacccagaacttgaaagtagccgtaaagaaaaaagatagtaacgagaccgatacggttatcagtccggtagccaatccttggatgactcgggatatggtgaacatgttgaatgggttaaaaccggacgccgtaaaaagctaccgtttggttgccgtaccacaatgctcctactctaccgtgatccagttacgtgactggttacccaatgcagtaggcggcgtggtttggatggcctatgataatcccggacaaagcccccgcatccccatcttctgtgggacgaaagatctcccggcttgcttcaaggtttgcggacagcaccgttaccgggaagatgccgccgtatgggctttccgtcgtgccaataaactcgctaccgtacgttggggagcgactaaagatcgtatgaaagcatctatcgcccattttacggagaaagggcagacagaacttcctttcgtagagagccgttacaaagagattcttacccaacaaggtgaggaggccgcaaaagaatacctaaccggatataccgccgatttcgccggagccacgatgctacgctggagagaaatgggagactcattctggacccaattcgaaagaggcttctaatcaccacatccgatagtagagacgaggcacaccccgtctctacaataataatataaacttaaattcatatacaatgagaacattcattctatcatgcgccttagcgttaggttccttgagcacattcgctcaaggctaccaatttacggatgtagtaaaggtacccgccacgccagtcaagaatcaagcatccacgggaacctgttggtgcttcgccacgacctctttcatggagtcggaattactccgtatgggaaaagggacgtacgatctctctgagatgtttatcgtccgccagaaatacatgaaccagttgcaggataattatgtccgccaaggtagaggtaatatcggtcaaggaagtctctcccacaccttcatgaacgctttcaaccaagtaggtatcgttccggaagaggtgtactcgggtatcaactacgattccgaccggcacaatcatgccgagatggtaaaatacatcaaggcgatcgcaacgacagccgtggacatgaagaaacgcagcccggaatattacaaactaatcgataacctattcgatacctacctaggcaagcttccggagaaattcacttatcaaggcaaggaatataccccgaagacattcgccgcctccctagggttgaatatggacgattatatcgagctgacaagcttcacgcatcatccgtattaccagaaattcgaggtagaggttcccgataactgggaacatgcgcaaatgtataacctcccgttggatgagatgatgcaagtcgcggattatgctttaaataatggttacacggtatgttgggatggcgacgtgagcgagaaaggcttctctttcaagaatggcgtggcgatcaacccggaggtaaagaaggtggaagattactcgactaccgaccgtgctcgctttgagaaaatggacgagaaggaacgtctggaggaagtctacaaattcgagaaacctttcccggaagtaaacgtcaccccgcaggtccgtcaagaaggcttcgaggcattcgtcacgactgatgaccatttgatgcaccttaccggcatcgccaaggatcaaaacggcacgaaatattatatcacgaagaactcttggggaaccgagcgtaatactttcggcggatacttgaacatgtccgatagttttgtccgtgccaagacgatctatatcatggtacataaggatgcgataccaaaggcaatcaagtctaaattaggcatttagaacttccctatcgtataggatattacaatgcccatcgtaaggttgttagaataggcattcaaagcaccttacaatgggcattattagctccttagaatgggcatccgcggaaatcatggatgcccatctcttttttctctcatcgaacgagcctcaactcttcaatcaaccttgggcatttaccccatttatcgatcatgaaaaggacatagcggatatctacgccgatgcaacgttgcaaatccggttcaaaagcgatatcaccactcatcgcctcccagttaccgtcgaaagcaagtccgatcaaacgggcgtttttatcgaataccgggctaccggaattaccaccagtgatatcattgttcgagaggaagcacagctgcaattcccctttttcattcgcgtaaggtccgaaatcacggctacgaaccagatccagtatctccggttgtacccagaactcatcgctcgtcgggtcctctttctctaggatacctttatccgttgagtaataattgtaccatgcggcatcataaggacgataccctccgatagaaccatagcttaaacgcatcgtgaaattagcgtcggaagacaaagctttctccggatacatctccttcaagccagcgaaatacaaccgttctcccttagcgatatcatactccgcatcgcccatcaactgctgtaactggaagatagacaccaatacggacaagctcagttccgccgccggatcttttctcaatttctcatattgcttcggatttctcaacatctcggcgatcttgtcgtatgacaataaggaagtctttttaaatacatccgccgcatatttctcataatttcctttatacttcttatcaatgctcgtataaatatccggcaagaactccgaagatacacgttctttcgcaatcttcatcatcgcggccaataccttctgatccaaagacggctcgtaatccttgaagaacggttggatacgatcctctaaaaagacagtaatctcttccagagtagctccgtttatatccaccgattgcaccatacgagccaaacgaataatctccgctccactggaaaacgcctcattcaaataggtcaacgcctccctatacttattggtcgaggtatatcctttttccaacaaattcaagacctcgccatatttagcgccccgggcttgatctttcgctacccaatcagcaaaagccgtctcttccgcacgtttacgttcgatcacgtttagattcgccaatcctttattcataccgatcgagttcttccaataattggagcttcccgcatatttggaggcatatttgatacgtacggcgtcgctagccgacatagcctctttccagatgccctgcttgatgccacgcacctcgatacggggcttattactattctcgatacgctgttgcacgccccaagaacacaaataacgatccgtgcttcccggaaaaccgattgtcatggcataatccttatcttgataaccttgcatagacacctccgctacatatctcggggtataaggcttattatccgcgttgtattccgccggtttattatctgcgttagcgtacacacggaacacggaaaaatcaccggtatggcggggccacatccagttgtccgtatccccaccgaacttaccgatagagctaggcggagcgaacaccatgcgcacgtcacgaaatacgtcatatacgaccaagaaatacttgttattgttatagaaaggaaccacgtcggctgcctggaactcactattacccacagagtcacaaatcacacgaccgatagaatcggcggcggataaacgctggaactcgtcctctataccggcgatctggctgttaatacgatcgctgacgtctaccgtctctttcagataacgtaccgacaaacccgggaccggcaactcctcttgcttgctttgggatacaaaaccatccttcaaataatcatgttccacgctgctcaattgctggatagaaccgaaaccacaatggtggttcgtaaagatcaagccctcgtccgaaaccgtaatacccgtgcatccgccaccgaagattaccacggcgttcgccacgcaaggatccgtctcactatacaactgatcataggatggggtaaaacccaactcggccattctcgccaaattctgcttattcaattccttcagcacccacatgccctcatcggcatataactggccggaagcggctaaaagcaacaaagccgcccacactcttttcatcaacttcattcttctcttattagtctaaattattcgattagtaacttaatgttttttacctcgacacgggccgacaaccattctgtaatctttttacgctcaacctctttcaccttcgtcttactcttcagataaaccagcatgaccgtatctggtttcgccgtctccgtattcacgatataggtatgcgagcaagaagcctctaccacaaagggaaacaacactttcatttccgggatcaactcggatgtcagacgcccataactctggtatttgtcaacctgccgttttaaagaatcgatctggatggtttgcacacgcagcacctcttcgctattcttatacaaatcctgcatcaacaggctcttcagctcgttgatatccgtcgcttcctggccaaagccctgctgtacgatcaaatggacatttttcaatccgtattttggcatcttggcttttgcgttcgcgatcatctcgtctggtacggtttgtccgatcaacaccacttttacctctttcttctcgcttgtatccgtaatcaccttactcaatatttgcgtattcgggaaactcagttcttcggtgacgaacgttcgtaccctctcattaaaataactgctacggattaagttataactcaagaaaagactgggtacgatcgtaaagaatacgataataccgacatagcgggtcacgatcttttcccgttgtttatccaggaatactttcttcggatacttcaataaacgtaccaccacataagtagccaagctaataaataccgtattgataaaatacagatagaaagcgccgaaaaagtaatataaattaccactcgccaaaccgaatccagccgtacaaagcggaggcatcaacgccgtagcgatagccacacccgggatcacgtttcccttgcttttcgtagagctagcgacaattcccgccagaccgccaaagaaagcgatcaacacgtcgtataccgtgggctgcgtacgggcaagcaactcgctttgggcctcactgatcggtgaaataagaaaatacaaggtagacgttattacgctgaagaccgtagccgtggcaaaattacggaacgatcgcttgatcaagtcgaaatcggagatacccaatcccaagccgaatcccatgatcggtcccatcagcggcgagatcaacatcgcgccaatgatcacggccgtagagttggtatttaacccgagagaagcgacaaacgtagcgaaaataagtacccataagttcgtccccttaaactctatccccttcttaatggattctatcgtctccagctcatcttccttttcctgccggacatcaaaattacggacgaaaaaatccataatctgtttatgtagcaatcctttttccatgcggtattaatcttgtcccatatttatgcaaagatattccaattgtttgtttttctaactatttaatagcttttttatggtgagattacgtatatttgcatttacaatacaacaacaagagatcctatttgtatgaaacgatatctaatgcttttatgcttattgtttacgtcctttgtcgtttcatctcaaacgacaacgccagactcgcttaaaagcgccttgcaaaaagcaacctccgaacgctctagactggaaatccttaccaatttaatggatatctcacgaaacgatgacatattagtaaacgctaaacaactctatcaggaggccttaaaagcgaatgacaattactataaggaagcggcgttgaccgagattctccgacgttatatcaacacggaccaaaccgatagcgctaatacctacatcgccaaggccgagcaggagctaaaaggagaagccagagccagcctcgtgtcgttcatgaaaatgatacaagatacgcgcgtcatattctacacatccggtgaaccgagaaagaaagtcctcatgaattgcctattcaagctggaagaacctgataaattatctccctacgagaaaatagcctgcaattatatacttggtatggctgtcagcaacagcattatggaagaaaatatgcttaaggaggactttaagcaaggaagagaatatttcgacaatgttttggccgaggcggaaaaactgcccctacgatatgcgtacaatttcttgcctaacacctatttcatgctatgcgcttatgcgagtaaccctcaagaacgaggacaatatgctacccgttacctaaatacgatcttaggttactctaacatcccggagatgaggaaacgtccttacgcagtcaacaaacgtcaattattaagcgcttattcaaaccttgccattagcgccgaggctattggaaaggatttggcgacctcttattaccgtaagttcatgaatctgctgaaggcttatccggaatcagctagcgccgccccggagtatgagctctactacacctcatcgaattattacctaggtattaaggactataagaaattcattgagttcagtgactctttgatcaatttctccaaacagataccgctttacaaggaacatgtaatcgcttatgtgtccgcgaaagctgccgcttacgacagcctccggatgtacaaggaagcctatgagacatccaaggaatacgctgtattgctagacaccttacgtatgcaagaactcaggaagaaaatggaaaatctggagatcgagaaaggggcgaacgagttggtgatcgaaaagagatcattggaattggaattacagaaaagcaagaaagagaattacctgtatatatccttattgcttctagctttatgcgccgtgttctatatctttttccggctaggcaaaatgagatccctctatcgggcattgcagaagtctaacgagctggtcttgatagcgaaccagaaagcacaagaaagcgaggagatgaagaccgccttcatccggaatatgtcgcatgagatacggactcccttaaacgcaatcaacggtttctcggaactcatcaccaacgacgatatctccatggacgagaaacaggctttcagccgtattatctatgaaaactgttaccacttgacttccatgctgaacaatctccttgagatcgcccagctcgatagcggcaatgattcccttcctcttgttcccacacgtatccatgagctttgtttacatgagatgcaacaggtaaagaaatatcaagagaagccggagatcaactatgtggtggaaggcgataaggagaatgatatgatcttgaccaaccgtgcttatttcagtttgatcatctcgcatctgctggcaaacgcgaataaattcacggagaaaggaagcatcacgctttcataccatctggatagcggagccaatttagtgaccttgtcggtaacagatacgggttgcggcatccctcaagacaaacaggaatggatattcgagcgtttcacgaagaccaatgatttcattcccggctctggcctggggctttacctatgtcgcttgatcgttaaccggctaaacggtaagataaagacagatccgtcttatacgaaaggctcacgcttcgttatcacgatgccaatcgccacgccgtccaagccctccgaacttaccgattaacgaaagaaacgtcctacgtacgggagttctcgtaaaggtaaatcccttttaaccataaatgcgatgaatacgcctaataagatcgtgcggtatcccaaccggagccattcagactgtatcggcagtgccatgcctgccacgtataacaccgtcgccactccgaaataaagaaacgcggatttcaagtcgtactcgatcgggaatttcttttgtcctacaaaataggataaaagcatcatcaataaattacaaaagaacgatgcccacgcacaagccatataaccgtacgagggaccgaacagcaagataatagagaccgtggccacacatccgatcgtggagaaataggcgccccatcgtgtctggtcgatcagcttataccataaggagaggttgaaataaataccgaagaacaactcgcccagcatcacgatcggcactacccgtaatccgggataataggccggcccgacaaagtacttcaagatatcgatatagaacattaccccgaggaagataaacaaggcgaatatgatgaaatatttcatcgcttccgagtaggctttcttattatcatcgctcttgtttttagcgaaaataaacggctcataggcataccggaaagcctgcgtgaacatcaccatcaccacggcgatcttgaagcatgcgccgtatatacccaattgctcattcgcgtactccttatcatcaaacaagaatggaaacaggatcttatctgccgtctggttaaagataccggcaatacctagaatgaggatcgggaaggaataacgcaagatttgtttcaataccgttccgtctactttcgcccgtatgcccggcaagatatccgggatcaaaagcaataaggttatcagtgtcgtaaacacgttcgccacgaatacatagcctaccccataatccggacgatagaaccagcttatcgcctccggatagtgcgtatgcaaccacggacaagtgatcaagaagaatatattcaagataatattcaagaaaatactcagcaacttaatcccggcgaaacgccatgctttccccttataccgaagataagcgaacggaatgcaacaaaaagcgtctaccgccacgatacccgccatcatcccgatatactccggatggtcgccatatcccaagccggcgctaatagatggcaataaggcgaaaaccgctacgctaaacagcgccgaacttcccagcaagcaatacagcacggaagcatacacccgcatcggctcttgctcctctttcttattgatgaaacggaagaaccccgtctccatgccataagtaagcaagaccaacaacagggctgtccaaccatataaattcgtcacgatcccataatcccctgttccggccaatacacgtgtgtacatcggcaccaacatccaattcaggaaacgccccactatactactcaatccataaacggctgtctctttagcgagccgcttcattcctcctgccatatcgtatctgtctaatcaaataaaaaaccttgttcccccacccggctacgtcccagatgggtataagctaaatcggtgacctcacggccacggggcgtgcgtttgataaagccctctttgatcaagaaaggctcgtacacttcttctagcgttccggggtcctcgcccaaagccgtggcgattgtcgttaatccgaccgggcctccctggaatttatcaatgatcgtcgtcagcaacttattatcgatctgatccaagccataccggtctatattcaacgcctccaaagagaagcaagcgatcgccttatcgatatctccgttccccttcacttgagcgaaatcacgcacacggcgcaataaagcgttggcgatacgaggcgtaccccggctacgggaagcgatctctctagcggcgttcaactcacattttacattcaagatattagcactacggagcacgatcttcgtcagcgtctccatatcataatactccaagtgcatattgatgccgaaacgggcacgcagcggactagtcagcaagccgctacgggtcgtagcgccaatcaatgtaaacggagccaaatcgatctgtatcgagcgagcgcttggtcctttatcgatcacgatatcgatccggtaatcctccatagcggaatacaggtattcctccacgatcgggctcaaccggtgaatctcatcgataaaaagcacgtcgttcttctccagcgaggtcaataccccggccagatctcccggcttatccagcaccggccccgacgtgaccttgaaaccaacccccaactcgttcgctataatattcgacaacgtcgtctttcccaacccgggaggtccatgcaaaagcacatgatccagcgcctccttacgcatgcgggcagccatgacgaacaccttcaggttctccaccaccttcgcctgtccgctgaagtcacggagcgaaagcggccgaagcacgttctcgtactctcgctcgttttccggcatccgggcatcccttatatcaaaatcatcttccatattcacgttcattgacttgcaaagataatgttaaacaacacattcacgaaaatagatgtataaaatatttttctaacagtgagaaaagcatatgtttgctaaagggacacctttaaaaacatactaccatgaaacttatactcacaatctctgcgatgatcctgttcctgataacgggatgcgaaagtggtaagcaaccggctaacgactttttaaccgtggatatcacggcaaattatccgaagaaggaactgattcttcaagactttttggatgtggaatacatcccattagaaacgaatgaggaattcataacctcagccagcatgcaagccatcggcaaaaatctcataatccttagaaacaagaacggacaagacggagatatatttatcttcgaccggaccggaaaaggccagagaaaaatcaaccgcagcggccaaggtagccaagaatacacgaatatcgggtctattgccctcgatgaggagaaaggtgagctgtttatcaacaactactattcgagccagtttatcgtatacgacctgtccggaaactttaagcgaactttaaagtacgataaagattttaatttcaatagcgggaagatatacaatttcgatcaagacaacttaatctgctacgatgagattggcaattataaaaatctgagaaaaagcgcattttggctcctgtccaaacaagacgggagcattgtcaaggaaatcgaactcccttatgagcataagatatcaccgtttttatcaaaaggaatttggtccgcaggacctcgtaataccgaattaatttcccaaaatggaagttgggtcttaatagagccatctacagatacgatttatagttattcccaagatcactctatcaaaccctttatcgtaaggactccacctatccgctctatggccccggaagtatttctttatccaagtattcttaccgatcggtattatttcatgcaaacaacaaagaaacaatgggattttgagaaagaaaccggattccccagaaccgacttggtatatgataaacaagaggacgctatctttgagtgtgtcgtatataataacgatttcgtagatcagacacccgttgatatgtggtacgaacatggaatactaaagatcatcaataacgatgggatcgctttcataaagaaactagaagccaatgagttggtggaagcctacgggagaggtaagctgaaaggtcgcttgaatgagatcgcagcgggattgaatgaggaatccaatcccgtgattatggtggccaagtataaggagtaaaaacttcttacttattgtctatttttccagacttgttttttattcgtacatgtttttcggaaaacacgtacgtgaattcccaaaaacacgtacgtgaatccgtgaaaacatgtacgtgttcttacggaaatccgacaagcatatttatccatcttactatcagcaagttataaatcgacttcatagtaagatattattgttgaaaatttacttctaaagatacggttcctctcctatattttatgtaactttgcttataagtcgcataaaatataggacgatatgaaccagacaatttatccaatcggcatacagaacttcgagagccttcgcaaagatggttatctctatattgataagaccgccctaatctaccaattagtaacaaccggacgatattatttcctcagccgcccccgacgcttcgggaaaagcctgttgctgtccacgctggaggcctatttccaaggaaagaaggagctgttcgagggactggcaatggagaaattggaaaaagactggataagataccccatcttacatttggatttaaatgcggagagatattctgaccctggggcattagagagtatattacgacgttatctgaacctttgggaagaccagtgggggaaagacgagagagagataacaccatccgatcgtttcaccggcgtgatacgccgtgcctatgagagaacaggacggagagtggtcatactggtagacgagtatgacaagcctttgctacaggcgatcgggaatccggagttacaggaggcctaccgctctatactgaaagcgttttacggcgttctgaagagcatggacggatatatccgcctagcgttcctgaccggcgtgaccaagttcggcaaggtaagcgtattcagcgacctcaacaacctcatggacctgtcgatggataatcggtacgtcgagatatgcggcatcacagaaaaagagatacatgcctatctggaagacgaagtgaaggaactggctgatacccaaatgacgacctacgaggaaacctgcctaaaactcaagcaacgctatgacggataccatttcaccgccaagtccgagggtatatacaatccattcagcctattgaataccttcgctaagatggaattcggagactactggttcgagaccggaacaccctcctacctcgtggagctgctcaagcacacccattacgacctctacgagatggccaacacggagaccgacgccgatgtgctgaacagcatcgactccgcctcgaacaatcccatacccgtcatctaccaaagcgggtatctgaccatcaagggctatgatcctgagtttggcatttatcgactgggtttcccgaacaaggaggtggaagaaggtttcgtcaaatacctacttcctttctatacgagcatacaagcctctaagacccccttcgagatcggacagttcgttcgggagatacggtctggcaattacgacgccttcttccaccgcctccaaagcttcttcgccgacacaccctacgaggtgatcgccgggcaaaagccggagcgagacacggagctgcattaccggaacgtcctcttcatcgtcttcaagctggtcggcctgtacacgcaagtggagtaccatacctcgaacgggcgtatagacctcgtcttgcaaaccgatcgctatgtatatatcatggagttcaagctcaacggaaccgccgaggaggccctgcggcagatcgaggagaaaggctacgccccacctttcgccggagacaatcgggaggtcttcaagatcggcgtgaacttctcctctgaaacccgcaatattgagaagtggctggtaaggtaaaaagcctgcttttatccatatatacttactttgccgatgaagtatatatcctatgcccggagaagatatacttcaagtggcatctaagtatatcttctccctcaaaaaggcttctctagtgaataactgatcacttcccaagccgttaactgacggctacccctactcgtaagttattcacttgacaagccataaacagacagtttacaactagcgtaacaatctgttattcaatgcatttacaacagaaataaaaaccgttcaaaaaagtcggactttccagccggaatatcctcgcctttttgtattatctttatcgccaacaaataatacgcagatgaagaaaaacaaagcgtgtaaacccctaaagggtttcgcgggttcgaatcccgctctctccgcagaactaaccagacaatgaacagttaagtcccataaatccaacgatttgtgggactttttagattttttgttacctacactaaatcttcttgtttgatcgaataacacttagtatttgtaagatgacagacaatattattacccctagccctatataaaaagcggcgttcaactctttagcctcactaaaaagaagcatagccaagataatgctataaataggttccagattataactcaagtttaccgtgaacgcagagatctttttcaggacttgtatctgaagtaaatacaaaccaatcgtacaaacagaagctaaaagcaataaataagtaaaatctaatagcccgggaacaatcgtcgatacaggaaaatatcgcaaatagaacggtaaaatacaggaaagcccgataaagccacctaccatttcatacaagagcatggtacttgttgaataattatttccgatcttcttattcgtgatcgtgaacaaagccgctaaagcggatgatataatacccaaacctattcctaaacgatagcgagtatcaaaatggaaaatcagcaccaccccgaataaagtcaacaaactaaaaacaacctccttgaaagacactctatgacaattaatcaatggttctagaaaagccgtaaagaaacctaccagagaaaaacaaaccactccaatagacacattcgaagcctttatacttccataaaagaaaacccaatgcaatcccagcaataaccctactccccctattctcaaggcatccccgaaagaaattcgattcaatcttttgccgacggataaaacgagtaaaaacaacaaagacgcaagcatcatacgataccagaccaatagggcttcattcaagctaatcaattttccaaatatgcccgtcgcacctgccaaaataatagatatatgcagttttataaatgcgtctttcattatgtcactataatatttaattatggacaaatgtacaaaggaaatataagctatcgaattcaaacttgataaatactccgttttttaccctaatggtaacttttttctaaatggagaagcctacttttgtgccgcaaaaataaaaagaaaagaaactgatgatgcaagacagtattgattttggaacaatgaacattccgaagttgttccgtatgatgtttatccctaccttattaggtatggtcctttccgccactataaatatcgccgatggaatattcgtaggaagaggcgtaggaagtgacgccttggctgcggtaaatatcgtggctccttttttcatgttagcaaccggaatcgggcttatgttcggagtaggcgcatctatcgtcgcctcgatccacctttcacaccagaaagtcaaggtagcgaatattaatatcacgcaagcgctttcggtctcattatgtattatgttatcgctttccttgttagtgatgacattccgtgctgaggtcgctcttttattgggtagttccgaacaattattgccctccgtattggaatatatgaactggatcgccccgttccttgccttttacatgttattgaatatcgggttattcattatccggttagacggatcacctacatacgccatgttatgcagcgctatcccggccctgataaacctaacattagactatattttcgttttcccattgcattggggattaatgggagccgctttagcttccgctatttccgtaatcgtaggaagtattatgatcgtggtttatatcgtaggtttttctaaagtattacatctttaccgccctaaattctcgcttaaaagtatcttattgacaatccgcaatatcggatacatggtaaagcttggttcttctgcgttcttaactgaggcagctatcgcttgtatgatgctggtgggtaattatatattcatgagataccttggggaagacggggttgccgcctatagtgtagcctgttattgctttcctatcgtattcatggtgaacaatgcgatcgcccagtctacccagccgatcataagctacaactatggcatacagcagtggaaaagagtacggcaggcgtttaagttagccctgctatgcgctgtcgtgtgcggaggactcgcctgcgtgggtactattttattctgcccggaagtctcctccttatttctcggtaatcatggcaacgcttacgagatagcggtctccggcattccctatttttctttgggatatgtctttttcgctctcaatatcgtttgtatcgggtactaccagagcatagaacgtttcaaacccgctacgctattcactattctacgaggaatcgtgattatcaccctaagtttcatgtacctacctgttgtctgcggaattaaaggtatttggctggccatacctttgtcggaattaattacttttgtaatcatagtggtatactatctattgaaacgtagaagagcatgaaagaggaagttcgccagaaagtgatggaacggttttcaatctctgagcaggccatgcagttattgctggaaagcgcagagatgatgtcgtttgtccccaaagatataatcgtacatgaaggtgagataaacacgaatatgtatatcttatccaagggaatctggcgggcttatacatttaaagatgggacggaagataccttttggttcgccgtggagagcgagatcgcactcccggtatggggatatacttccggctctccttctctttataccatagaagccgttacggaaagcgaggcgtattgcctatccaaacagaaactagaaatcctatttcaatcctccgtgcaattagcaaatatcggaagaaggattctagagaattttatgcttgagatcgagacttcatggttaagttcttacaaacgaaccgccattgaacgttacgccattctattggacaaacagcccgaaatcatccaatccgtccccctaaaatatatagcttcttatctaggtgtcacggctcaatccttaagtagaatccgggcgaagttagctagttctttaacctttatcgtgtaaagcctcttcatatcccctcggactggagataccatgtccagccatttatatttacctgtacggcattccatgtattatcagcaaagaaaaagataatcttatatctatcttggcgatccagatattcttgtacatccatattatttccctccatactagtcaaggctaaaaaatctgtcaaattaatattgaatacctttttgccggtagacttctccgttacgacaaaacgtgtcggccgatcttccatcaaccgcatcgtgttcaactcgacagctgccgccgatgatgacttttgttccatataataaggtcggaaacttaacacatcatcctccaataacgagttgtcataggccagatggccattcgactcgatgatctcatattcataatcattcatgttcacattccaattatctccggaggtagcccggatataactatcggaataaccttgaaaaacaaaccgtatcttattcgtatcttttatcagatcaatcgtctcagtctgatggctggtccctgtaaaatcaacgtcactgatataaccataccaaagaggctccagttctttactgatgataagagactcctcacgtttcagccttaacctcatatcagtaatcgtattctctcccctaggcgtataaatatcgtaggagtcacgtgcgccggcccaagccagaaattggtattctcctatcggaagctttacctccatttggtaattgcctgtcgccaacgcttcaccttcctctacttgactgaacagaaactttccgtctttgtcaaatacataaagctccactttatccacctgcgtatggaacgcatccgtgaaaagcatattatagtcgtacttaaacttgacaaataaacgacattcgggaagatcctcatgaaacatatcgcaagaggtcaatatccacggacagagaataaggattccccaaattgtataacgtataagacggttctgtttcatatttttctatttttctaattaatccttactctaattaaagggagttcccagaaggaaaaaacactgtttggaaactccccttttctaacctgcgatacctaactaataacctaaaatcataagatctcctcttggctataccaagtccacgggttcacgttaatctggatagacaaccatgtctcatcattctcatctggcgtatctgggtccggatccggaatagtaggataacccggattattaaatcccttgatattaatatcataaacggaattacgcacaaccccaaactctccaaactcattcatcgccttatccgagtcatcatgtttaatcatgatcttgtaataacttacaccaccatcataataaaagaccgtaccataactacccgcccctttattctctacggcaagccttgcgtctacaaatttctgtttaagtgccgcagcctgcgtttctgcgctttgaccggattgcttaaattcatctccggttggaatagtaacctccttggaggaatccacgtattttacataccggttgaaggctgttgatatagaggttggataaccgtctgggttcccatccttatatttctttgtcaactcattttctatccagtccatcaaggtatcatatgtatagcttacgccatttacgatcatccaagactcaccctctcccacatcaaccgtaccgccatctaattttttcagtttcttcggcgcgaagttcgcttgtaaaaggacttgggtcgtataagcatggttgttatactctttttcttgtgtattctccagacaatattcagtaacgggattagatgctgaacttatctcattccaagatatggcagatgcgttcgtcgaagcagacacaaaattgtaattattcgtatacgccacttgattcgcctcgttccactcaccgatattcgtattgttgtaattcgggtctacccggtatgaaccgatctcatacctatcgaatggagtgacacaagtaccgcgagcatccggagtattggcaggatcttcattccaagtcttaatcctcctcgatacaggataataccatttattagtaacgttcagaatccatttcgggctatagatcgatgccgtgctattatccatagcgccatcgctggtatatacacgtactttagcgacaacacgatctatataaatcgctagcggattctttaccgcgacatcttggctcttataaagagttaagtttatcgtatttcccgagttatccgaaggttccagatgaccttttgagtttgtcatcaaaaatgttcctgttttcgcgacactcgttgttatcgactcatccttcaccgccttgttcacatccacgaaactagagccttccccgacgctggagaaaccggcacccggattcgcgataatcagtattgtcttagaagtagccggaatctgaaaagccttactgctactgcttgcgccggaagatgtcaaatcaccggagccggtacttaggtctatcacttttgtaactagactcgcatcttgatcgccatcgaagaaaatcgctttaacatcctcaatctcatattcgcctgttatcgcattctcttgattagggatattcaatccacgggtaacggcggcgggagtcttaatattcaaagccacccacgcatcgcccgaaggatcggttactacatcgctattcccatccgaaatagcatggtcatcactacacgcagcaaacactagcgtcgcaagcgcaaacataaaaagtcttttctttttcattttacaacaattaaactgtttctaactaaacacttatcactttttatctcttagtcatcttttaatccgtcacgaccgtttgggataattgactaatatttaactttatacgttgtacagaattagtattcgaggatacaccgggatcttttatagtagtcaggtatataatgccacttctctgtttggacattgtattccccaagacttcaatataaattgtcccatcatcaaccgtgatcttatccgtgtcctcccgtacagcgccgacggaaggacgcagctttatccagctcttaggatcatccgccccatcttccacatatgcggaaagacaatagtagttcatatcgaaactatcgctgctatccgcagccggcatatatttaattgtcactccagccgccggtatagcatatctttgcctaatacgcaccgtcttttcgagagtccccaatttcagcgtgatatacgcatgatctaacaagccattcgatatttgagcttccacagccgtgatattcggatctgatgtcgtatcatccacgatcggtattctcgctccattagatgggtttaccagcaagggtaccccaatgccgacctcgtttccattatcactaatccggcaggcattcggaaaacgagtccggcaatccgtaatcaatttaaaaacctcaaaattggcaccctcactcgtataggcgataaataccgaattactgactcccagaaagaaatcgttgttcgctacaacttcgtatgagtctctattatcaactgagatctcataatccagagctgtgttggaaggtttagaggcttttgcatcttctaccgtatcatagccgggaccttttgccgtaacaatagtgaattgataagaatgattacgttgtaaatccattaactggacatccttattgacgatcgccattttatagaaataatcccgtcccccatacgcaccttgaataatcaagtgtgtattattccgcatatcagactcatataaatagactggatcattctcagtactctcccccccatctatgaaatctgcctgaaccaataaggatgaataagcagcatcattcctgtattcagtcaaattagaggtattatccctaatgagaccatccagcgtatgaaacggtccttgcctaggtacattcataaccgccacaactccctttagctcaaagttcgtcgccttattgacaattaccattttagcgatcgcccgggtaagcatcaagggcgttccgtccgtattctcgatctttgttgtatgatctatcttatctacttccagtaaataactcatcgggatcacttgcccgttaccactataaggaatgacagaaaccgaaggtaccgccaatggagccgtcagcatattcgtacagaaatcagccaatgtcgtcaaaccttgcatcaattgggcagaaaatccagtttcatcgaatccatattccgtaaccgcatccccataataaaatctatcgggtgaattagccaatatcaataactgatatttactgtcattcgattgtttagtcaatatcacatatctttttcccgctaattcaaaggcttgcacggcttccacaaaagtagcgttaggcccttctcctttgaaaacaaacatccatgggttcttacccaccgtaccctcatccataagtccttttgttgacgggagatggtacgaattagcacgggcgaaaatctccagctgtactttttcagaaaagacttcttcctctcctacctgttcagacaaagcaaattcatgctcacagccagatagcattaatagggataacagagcccaaaaaccgatcatatgcatactaattattctcattctttcacgcaacgaattgtaaaaccaaattgatgactcgaagacttgggagttgtcgctaaataattatactctatcccccaaatattaccgtgagcagaacctttctcttctccacttgacgtatcagtccaccccggagccgctgaagaagaccaataataccctgtctcactcgcatattccaaactaccatccgtatgccatcttcggcctgcggccggaaagaaaatagaggcgttattgtccggattaaatatcaagacacccccataagccgcttccgtcgtatctaaagacactcctttatacttactgaccttccccgaacctctttctatgccatcgatcatatctctttccacgataggacgcctgtcgaaaaaaccatccgcatagaatccgtacttgatctcttccagaatcttagggatatatttctccggtttattctgtggatcaatcggtttttcagccgtcacccaatttccatcccctttcattggattacggaataacgacattcttatctcggatttatatacatcattataggtataactattcaacacaatcctatccaagggaccgtcgcttggacgatgataacccgggggacagatctcgtaataatctttcagtttatccccgctcgtagcatcccaaaaagtgggagtctcaatacgtcttatcggccattccgataactcccacgtagcactcttattattcacgttggtagggtgatacgcacgaagtgctaaagaagcatatgctaccggtaatccccattgaaaatgagcgccggcttgagtcggatacttaacaaaatcaacttgatcagtgcttttatctatctgcctccattcatcctttgtatcaacatcatttaagaatgaccgagctgtcaaattgtacgcactaaattttacacctaaatccggcccctcgtttgtacccctccgcattatataatcaggagcctctccttggcggacatataaatcagtttcgtaagtcgtcccattttccgtataagaaagctttacgacaccatatctaggcactccttttctaggattcttgctcttcaatcctatccggaagtaaacacgtcctcttccttgtacaaaactgcctgtctcacctttctgtgaattaggaataaccggatagtcttccggatctcccggagaacctgttccaacgttaggatcaaagctaggtgtcgagcttatcactataaaatcctgatattcggttggaacttccacacgccactgataccaataactccacttgttcccactaattatcctttctccactttcatcatccttatagaaagcccctacataagggttagaccatagatgattcgttgaattaatatcaaacggataacgatttccatattgactgacctttacggttatcgttctacgaatagcgttcttccccgagaaatcttccgcagccatcaatgtaatctcataggtttccttacctataatatagtttggcaaatcaagtaagatatccatatagcccgctccagtactcggatcatacgaaatcctctcatcagcgttcggctgccactcttgactcgacaaagcgttaaacacctcattcgtttccttataagtgtttgtacttagcacttttactttatcaaaaatcctcacaaccggcatattggacgagaaagagattcgtgccccgttaaaatcggtaatatcgacctctgtatgtgacacatttagcactctattaccagatatattccaatcatttgctattgaatcccaatccgatgcctgtatattcatctccaagggttgtttaatgatcccggtaagatctagcttcgtatttttaggtaagttataatcaaccggctctgagtttattttcaactcacaggagggattatagctatcctccatatctaccgtaaaaaccaccgcatttgccggatcgttctttctctccaactcattagagggcaaaataatacgagtgatcttccgagcccaattcattccgggaatatttggagtaacagaggagaaataatcaccatcttctctcaatgtaaaattacgtgttacattcctctcaatagtagagccactatattgagctgtcaatgggatcaaattagggataccactaaatataactccattaaaaatatcatcgaaattatctgccgcctccaaaacaacatctactcgaactcccagacgattaagggccagttgtaataaagaaaccgttgtcccatcactcaatttagcccctttaccttttggtaaaacctctacgttatttatttcctgcatcattgggatcgatttctccgaagaaaaagagcttgcgggataagcgataagattcaaatcgtcataacgtgaaagagtgttcagtttattggctataacgttatccgtcggttcattcgccaaaaatacgaaatcataattcccagctacgattggatgccggatgatattttctatccattgattcttactatagtgaatattagatatgcatgctcccgttgtcttattgaaagccaaaacacgaagcgtattcacgtcgtagtcctcttcgctacccgaatgagtcgtattttgagaatctatattcctaatagaaatataggctccttccacattaccgctaatcattgtctcatccgtacatgagaaaaggattatcaataacaagactgccacgaaacctttatatattttacactcttccactatcataaaaattgctctaatgttataatgcaaatatcacgatataaaaagtcacaataaactaaatatgcacccaataatgacaatatgaatcacagtttacatctaattatgcaattatttttcaggccgttacagtttccagaaaaacaagatcaaaaggctctatttttctattatacgcaagactcttatcaaacagttccgattatcgaaacaaatcacattaataagaatccacgaaaaagcccttaaacgaaagatcgcttaaaggctcaataaacatcccttataatattcatttatgtagaaattaggtccgttatatttcgtcttatctataattataatatatcaataaccgatctctgtctttttataaaatcgatacgttgtgcctctccactttcggatattaggatagaatggcgtttcaatgcctgaatccaatctcgttgcattttacaaatctgcggactttgggagtccatagaattgattgaataaactcgtagcatactaatttggaaatccagcttctctatataagtataggttgcctcaaaatcaatgcttgataagtagaaaaacaccttatggccctcactgaactctcctgtgatagataaagcctccatatgagtaagtaattgataaagttcctctttcaagcacagaacatcctctttcgatatcaaattcaggcaagcaaagtattggacctctttcacgaaagaaacaaaaatattcatatcccagataaaactggttttcggacaattctttacgctataacttaattttttatgtacatttataattcgttcttccaccaccatcccatatagagaatttggagtctttatctgtccatgatgatataaccagcggcaaagacggaacttagacagatattcaaaagaggaataaagcgtaaaaggcaaaacattcgatgccgtacaaacctccgtactcttatctcctttcacatagtcaaatatccgtaagtaacgatcaataatctcataataactttctatcgcattggcagaccggagcaagttcatatcgaaagtcactctattatgcaagtgatttcctatgatctgatctatggagatccccaacttataggaaatttgcgcaacctcatcaatcgtaaaagcgacctctccccgaagcctgcggtacaccgcctctctcccgatacataaagtatccgtcaagaaattagcaagattttgtccgggaggaagcctatctttcattgcggttatcaattcatttacaatactatctttcattgccttataccttatttccaactattaatattccttgatacatttggcaaatgtaaaacatgtaaacgatagttttgtacgataaagcaagcctatgagaattgttccttttctaattaaagcaaacacagacagaaaaagatagaaaacgaaattaaactaaaaaagcacctataaatttcgaatcgcacaatcggaagatctaggttgtttcatttatcgaaacaggttcaaaccctaaagcgtatttataatctccctttgtctattgaaaaactggatacgttgcatctctccactctcggagatcatggtagagaacttttttaaagattgaatccagtctttcaagctattaaacatctcagaatcctgtgtcgtaatagaatttatcgagtaaacccgtatcatacttaactgcaaagaacttgtttccagataactatacgtagcctcaaagttaatatgcgatacataaattcgtacactattgccagcctcggtctttcctctcatggcaagttcttccaattcatccaccaacactaataactcctctttgatacgttgtatatcctcacaggaaataagatggatatcggagaaatatttaatgtcattgaccaaatgatggaagatcatattatcccaaatataatccgtagaatggatatactgtgtcaacgatacaaattctctttgggtatcaaccagtttttccggtatcttcagattctcaaaatgattgcattggatatgcttattctgatacatccacttaaataaacgaaactttgacaaaaggtcatgcttcaaataaagggtctgaggaatagtattggaagaggtacccaaagccgtagtaggatcatcctgaaaggccctaaagatcttcacatatctagacaagatcgtaaaataagcattaaaaggatcatcgtgatctaccacattcaagtcgaacacggcattggcactaaaactaacccctactattttatccaatgacacacccaatttccttgagataagagctgcctcttccaaggtgaaaggaacctcgccacgtaagcgcctataaatggcttctctgccaatataaagggtatccatcaacagattcgccaaatttgtcttagggggaagtttttcttttaaagcttcaatcaagcctgtatttaattcatttatcatcataaccatgtcgaatgaaaaatcatctactctagtaacatatatagagaggaagttgtttcgaggacaagtacattcgtagatggattttcaaagcacgtagcttttcagcttattcatatcaactattttcccttcccgggaaatagccccttcctctatcatttccgagaaactacgggccaatgaaggacgggccactccaaaatattccgaaagctctgtttgattacgatcctgcttataatgatctccttgaatacgtttaagtatatagtaagccagtttacctttaatggtcttaatcgataataattgaagacgttcagaaagaaattgtgtccggttggcgttaaaagccatatagctttgaagaaaatgctcgtttgtcgccagcaaacgcatcaccgcattcttaggtattaaaatgatctcgcattcctccaaggcgataacatctaccgggaagcgattattttccgcaaacaaaaatgcggaggccaaaggagtaggcgccgataaagtctccacttccagaattgtcccgctttcggtgatcatctcagtctttacccgtcctttactcaatagataaagcgaagataaggcatctccctgacgagccacccagtcacctttcttaaacgaccttgtcgaataatccaacgaactgaaaagagcggtttgctcttcctcagacaattttccgcaaataggacacaaactcagattcataaaacttccttttgcggataaagataaagaaaataatcaaagagtgtaacaactgttacaggttaaacgatcttctatcccctacattcgcgataaacttataaaataaaagctatgttctgttatcaatgtcaagaaaccgcccaaggaaagggctgtatattaaaaggtgtatgtggtaagaccgccgaagtggccggattacaagatttactgatgtacttaatgaagggaatctccaaactaacaacgactttacgcaagcgaggcgtggaatcagccacggccaataagttcatcgtcgacggacttttcatgaccatcacaaacgccaatttcgattcatccagattcgtctcaaagatcaaagaagcctatcagctacgggagaaccttctcgacgagctacatcgacagggaatccatccatccttaacctgcgattgtctgacttggaaatcggacaaagtagaggaaatggaggtcaaatcgaaagaagtaggtattctcgccacagaaaacaaggatatccgctctctacgagaattactcacttatgggataaaaggtatggctgcctacgtggaacacgcttacaatctaggcttcgaggataccagcctctatgcctttatccaagacgccttggtcgcaacgactcaatcggacctgaccgtcgccgatttaacccgatgggtactcacctgcggcgaatacggagtaaaagccatggccttattagataaagcgaatacttccacctatggcaacccggaaattacgagagtgaatatcggcgtaggaaagaacccgggtatacttatcagtgggcacgacttgagagacattcaagacttgctggaacaaaccgaaggtacaggcatagatgtctatacacatagcgagatgcttcctgcacattattacccggctttcaagaagtataagcattttgtaggaaactacggtagcgcctggtggaaacaaacatctgatttcgagacattcaacggagttatcctgtttacgaccaactgccttgtccctccccgttcttccgccacttatgccgatcgggtctatacgaccggctctaccgggttcgaaggattcccacatatcgccgatcgtaagcccggaggctctaaggatttctctgcgttaatcgaacacgcaaagaaatgcgcccctccaacggaaatcgaacatggggaaatcatcggtggattcgctcatgagcaggtattccaattagccgacaaggttatcgatgccgtaaaatcaggagcgatacgtaaattctttgtcatggcaggttgcgacggaagaatgaagagccgtagctactataccgaattcgccgagaaattaccgaaagataccgtcatattaaccgccggttgtgccaaatatcgttacaacaaactgcctttgggggagatcagaggtattccacgggtattagatgccggacaatgtaatgacagttactcattggtgatgatcgccctcaagttaaaagagatcttcgggctggatgatgtcaatgaattacctatcgcatacaatatcgcatggtacgagcaaaaagcggtaatcgtattactcgccctactctacctaggcgtaaaaaacattcacttaggaccgacattgccagcgttcttgtcgccgaatgtagccaaagtattggtcgataatttcgggatcgccggaataggtagcgtggacgaagacatggaactatttctaggaaagtaaaataaacctttcccgatccgctcttgttttcctatcacattttaatcgattcaagatgaataaggaacaacaaaaaagagtagccgccattcatgacctatcgggatttggcaaatgttcattgacagttgccctcccgatcctctcggcggcaggaatagagacaagcgccttacctacggccatactttctacacacacaggaggtattctcggctatacttatagagacttgacggaagatatgcgtccgttcatgaagcattggaaagaattggatatccgtttcgacgccgtctacagcggctttcttggatctttcgagcaattagatatcgtaaaagagttcttctcccttttcaagcgggaagataacctgattctagtcgatcctgtcatgggcgataacggagaactatacaagatattcacccctaaattcgccaaaggaatgagatccctttgtgaaaaagcggacattatcgtaccgaacctgacggaggccgcattattgttgggcgaaccctaccaagcaggtccctataccaaagcttatatcgatggtattttacataaactaagtcagctaggccctaagcaagttgtcttgaccggtgtctatttcgacgagaaagaactgggagccgccactttcgatatggaacgaaatgcgacagagtatgttttaacagaaaaaatacccggttattatcatggtacgggagatattttcgcaagtgctttactgtccggtttgttaaataatttcaacttggagagatctgcggaaatagccgttcgcttcacgacagaaagtattcttcgaacattcaaggcgcaaacggattatcgctttggcgtgaacttcgaacaatccattccggatttactaaaagaactgaaactgatataaatgagagccttttttttctcatatttgcaaataaaaggaatataatagtatggctaaattaagaatagcgttttctggtatcggtgcggtgggtggttattacggaggtatggtcgccgcccgctatcaaggaacaataaaagcagatatcttttttatcgcccgtggagaaaatctaaaggctatccgtgaaaacggtttacaaatgcaactaggcatccggacaatccatacggctccggcactagccaccgataatcccgccgagatagggccggtagactaccttttctgttgtacaaaaagttacgatctagaagaaaacatccagcagctaaagcctgttatcggacctgagaccgttatcatccccttgctaaacggattggatatcgaagaacgaatccataatatactacccgaacaagaggtctggaaaggatgtgtttacatcggttctcgcttgacagagccgggtgttgtcgagaaattctccttgaaagaacgtattttcttcggcaacaaagatgcaaacaaagataagcaaaccgagttgcttaaattacttatgtatgcccggttaaacgcttttaatccagcggatatagacctacgcatctggaagaaattcttcatgatctctacggcggctacggctacgagtttcttcaaccagcccattgatgaagtactagcccaacatatcgacctgttcatcgctttgggtacggaattaaaaagcgtagcagaggctatgggagtccgtttacccgatgacatcgtctatacttccatcgagacgcaaaagatgatgccggccggctccacgacttccatgcatagtgattttctcgccgggaaaaaaacagagttggaaacattgacaggatatgtaattcgtcaagcggagaagctcggcgttgatgtccctacttatcgatttatgtataatggattgtctttttatccctatccgaagaaaacagaaatatcataattatgcaagatataataaacgggcgttgtggttggtgcggaactgacgagttgtatatgagataccatgatcaagagtgggggaagttggtgaccgacgataaaacactgttcgagtttcttgtgctggaaagttctcaagccgggttaagttggataactatccttaggaagcgtgagggatatcgcaaggcattttgtgattttgatatcgaaagagtggcgcaaatgaccgatgaagatgttgaacggttgatgcagtttgagggaattgtgaaaaaccgtcagaaaattaaatcgacaatcacaaacgcaaggcagtttctctccatacagaaagagttcggtagcttttataattacaccctatcattctttcctaaccaaaaaccaattatcaacacctttcagtcattgagtgagattccggcatcatctcccgaatccgaagccatgagcaaagatatgaagaaacgaggattcaaattcttcggagccacaatttgttacgcccacctacaggcttcgggatttatcaacgatcatctggtggactgcgtttgccgaaaaagataataaaaaaggggctgtccaaaaagtcgaatagccccttttgctattgtttatttcggtaaaaagtattatcttaccgttgcaaaaaacaaacattatagcaatggctaagatagtatttaaagagttaacttccaaccaaaatgtactttttccggtcagagctggttagaatacatgcctgtcacgcatggggtcgcgggttcgagtcccgtccagaccgctttttatttctccttcctctttttaaattttcctttgatacatgttttaatacgatatcatccggttctatggattttgcctgatggcatgaggttgttatatttggaatgtttatctttgagaccaataaaacagatagccttatggagaatctaataaagatcgataccgttgatcaatacaacaagatgtttggcttggagacgttgcaccctttggtgagcgtggtagatttatccaagtccgagacatggcctactaatttccggattaattatggtatatacggacttttcctgaaagatacgaaatgcggggatattcggtatggaaggcaatattatgactatcaagaaggaaccgtagtaggattcgctcccgggcaggtgacgggtattgagcttaaggatgggacccggcctttggcgcatgggttgcttttccatccggacttgatccgtggtacggctttgggacgggacatcaagcgttattctttcttctcctatgaatcaaacgaggcgttacatctctctgaggaagagaaggggatcttcgtggattgcctgaggaaaatccagatcgagttggagcattccatcgacaagcatagcaaacggctgatcgcgatgaatatcgagttactgctcgattattgcctgcgtttttatgaccgtcagtttacgacccgtgcggagacgaataaggatgtgttggtgaggttcgaacgattactggatgaatacctgcaaagcgatctgttaagacaggaggggctacctactgtacggtatttcgccgagaagatttgtttgtccccgaactatttcggtgatctgatcaagaaagagacagggaaaactgcccaagaaaatatacaagaccggattatttccttagcgaaagaatggatattagggacaaacaagaccgtcagccaaatcgcttacgacctaggattccgatactcccagcacttcagccgcatattcaagaagaccgtggggtgtaccccgaatgaatatcggaaatcccagatgtcgtaatcggtgttacgggttattggatgtattttatgaccttggcgggaacacctcccacgatggcattgtccggtacatctttagtaactaccgagccggctccgactatagcgttctcgccaatggttacgccggataggatcgttgcgttcgagcctacccagacattctttttcagaacgatcggggcagggtaggtagtgctccggtcttcgggggcgaagccgtggttgagggtggcaaagaccacgttatgcccgatctggcaaccgtcgtccagtgtcaccccgccatgatcttgaaaatgacagcaagcattgatgaaaacgttcttacctaccgtgatattcttcccaaaatccgtatagaacggggggaatacacgaaaagacggatcgaccggcttattaaacaagcgggataacagctcacggatttcctcgggatcgtgatatgagccgtttaactcgaatgtcatgcgtctggcctcatcgctcatctcgttcataaactgatggacctcgtctcctttaagaggctttcttgtctctacatacttcaagaattcgtttagtgtcataattgctattttaataagttctacttcttggtttgtttatcccttttcgattgcaacggcaaagatcgatgaaatccggagaaacttttgtagatggattacaggtattatgacctaaattacattcactgattctccaaagccttatatttctcgattagtttcttgaccgtgacagcgtctgagacctcttgcttataggtagtcgggttataataggcctcgaggaaactgtctgcaccggaccagactgtctcgataattccttggaaatggcgagacatttccggatttgaatgctggcggaaatggatcatatcatctacctgttgaagcgctatctgaggtttacgccaagggcatgtagcaacgtcgaagcctttcatggcaaagtaaacagcggtctgctcggcacgctcataatgccagtcgcagataaagacatctttcgggatcaagtcgatcgcacggtaggtattgttcatgctagcttcccaagcgccgatcccggtagtcttgccatcgatcaggcggtctccccatatcatcaatcgtttgccttgtgaggctaagtggttttgtattttagtgacctcaccggcatataactcagccttgtcatgtccgccacaacggacgcaactatcatgtccgatataaaagacctcgtccatccctgcatggaataattgagtctcgaaaacatccgtcaactcgtctactaaagcgaatacgattttatgtacttccggatgaagtgggcagtaacttttacaataaagcccgtctgagttgggccaacccgtatagttcttggtatccacgtgtggcgtctcgtcgaactccggatactcacgtaataaagcgtaggtagtctcagcccatgattgatgccccaagagattgatctggggagcgatacgtattccgttatcccggcaaacctttacgatctttttcacatcctctcgtgtgagtggggtcggatccctcagttctggatgggactcataggcataattccagtctacccgtagaatcaacaagttgaaatgactgggagccagttcctcttggacaaacttcaagaatagatccaacttctgtgcggatggagcggcgatggccaagcctcgtacgggcatgatactatctaaacggtttgtctctgattgggcggaaacttgggccgaacctatagcccatataagcaagaatagtccgataatctttttcatatagtgatatgttttaatgtttaaatttttaatttgatgtacgctttcgaagatcatcacgcatatcgtgacggcccggaggatgtcgatggctatgttacgttgcgtaaaatctattggttgatcgctcataatatatttagactaaaggtgaatttaatacaagacaaatataatcaataagagacatatcattacatttgtgccttataaatatgaataataattaaaaatgatagacatgataagacgattgatttattgggttctcctgctttttgtttgtatgggtgcccatgcccaattccgggtgacagcccatcaagagggttgggaccggattcctccgcaagcgcaaaaagacggcttttggtttcaacaatccgttttagcgaatatggatgatgatgccgctatggaggaggtcatgcttttcgggcgggataatgggcattaccctacttttgacctgtttaagttttattacgtgatcgtggataattatacgagagagatccaatatatatcggatgagatctatgtgacagataaatatgcgcttacggtggaggatcgtaataatgacgggatctccgagttatatatcgattatttcaaggatgggaagtttacggttgatgagcgaggatataatttgcgaaccacccgttgctacgaccgtatcgaatggagccccgagagtgaaaaatttaacccccaacaaccatgagaaagtatatctattttatagcgcttatctgttgcgccttatcagcctcaacctcttacgcccagaaaaaggtgataaaaacgatgatgatcgccgggcaagatggcagtcattattggcgaggtgcttgcgaggccatgaagcagatcttagagaacagtggaatgtttaaggtggatttcgtctttaccccggatttcggaggagatataaatacctttaagcccgatttcgctaaatataacttggttgttgttaattacggaggtgaagtctggcccgagcctgtccaaaaagctttcgagaactatgtagcggatggtggtggggtcgtgattatccattcctccgtggtacctatggccggttggaaagcgtacaacgagataatcggcatgggagcttgggaggggcgaaacgagaaagacggtccttacctgtattggaaagagggcaaatatgtatacgattatacacccggttatgcgggttatcatggcttgcagcatgagacgatcctagagcatcgtgcgccggagcaccctattttgaaaggtctgcctataagatggaaacattttaaggacgagatttatacccgcttgcgtggtccggtacggaatgtggagatattggctaccgcttatgagcgtggacgccatgaaccgttgatgtggacggtgaagtgggggaaggggcgtgtctttgtcgatctgttggggcattgcggcaatgacccgaatatgatttactcgatggagtgtacgggttttcaggtaaccttactaagaggggctgaatgggcagccaccggggaagtgacgcaagaggcccctcgggatttcccattggaagatacctgtacgctccgtccggaattcaaggctcctttccatgcgacgaattaaatgccttaataagatggtgtctttcgacagaataatcaaattgacaaattgtaaagttaagtcccggagaatcgatttttccgggacaaagtacggctcgctcctaaatacgcaagaaaaaatcagtaatcgtttgttaaatagatagatgtcaaaaaacagcctttcattctagcgaaattagttcatcgtaattcatatcttatgggttgtttgggctatctcatagggttacgatggggaaatgatagggttatgatgcctattcatgacagttcataaccctattcatgactgctttcgatgcccaacgtgactattggcgttgcctaacacgactagttgcgtaggctttcatgacctatcgtgtataaaaagcggcctttttgagtaaaaagcgccatatatagctatcctctttcctctacttggcaatctctctcaaaaggttgtgttacaagatacgccttatatctattaaaaagacaggattagatcgtatatttgtcatctcgcttactcgtcatacgagatattccctaattccttaatcttcgaatctccgacttgatgcgtgaataactcgatcaattgagcgggcgttaatgtcatctgaggcgagaactcggaggaatccatataacttaataagctatggtataattgacgggcttccgggtattcttgttgggtttccaagtctgtcatacagattaataacttacccgggccgacattgaattcttggatcatccctaatttatggttacgctccacgttatcgatcacttgtacgatcggcctgtaattatccggaagctggtccagtatcaacggatggctattctttatcatcgtgaaccattgccagtttgtatggaaatccgtcgggaaatgagtgaaagccggatgagagggattcattaataatccgagggtacccggagagaccggtttctttacccattcgcagatggacttaaacatccggtaattccagtaatctgtctggaataacccgtctaccgtcacgctcttgtaagtcttggcatccgggaaccacaatactttcgccccgttcgccaataagttctcggcctgtttatcccatttcttaataacattgatatccgtagggatttgcacgttattatgttccggataaatccataacggataatgattgtgataatccgtgccctcgatcgccagccgtaaagtataggtctcagcctcttgaatggcaggtaaagcgatatttaatgggtctacctcggccaacgtcccttgattgatttgcagcggtatgttgttttgggcgattacttgatcttgaccatttgtcaaggtccaagttagatgtttcccttttaaagcggtaggtgtatagttcgctaccttgatggagcctttgagcgcctcattcccggagtaacagaatttaggcaggagagccaataatacgacatcatcgcaagactctttccattcctcggcggttatcaaacccttattatccataaaagcgtctaagataccgactaacgccgtgccctgtcccggataatcctgtaaatccaataattggaagccggccattcccggagtacggaacgccatttccatctcggcccggtaaagttgcgccatccatttaccggaagccttgaagaaatcatccgcttgtccggccataccggactcgcccagtcgtttgcggaatatctccagattccaaggttttagtgccccggtatattttttgatttcctcataattcggataacattggaattgcccggtttcgtgtccgatgataggcaatgaacattgttcgatggcgaattcgaaattcatgaccgagtttggataggtatggttgatataaccgccatcctccgcatctgcgaaagagaaggaaccccgggtatggttgctgaatacgttagcgccggggactcgacaggtcgtgaagtaatcgtcacccgccgcagggccgttgaagcctagatagtcattcgatccagatgcgtataaatgccgtccgtcctcactacggaaacgggcgatcatgtccaccatcgcgtcttgatccccggaaagctcgttgccgatcgccatcatgacgaaagaggcgtgattcccgtaagcctcctgtatttgtaatccttctttggtgaggaaatggatcaaagtggtatcgcctttttccatctttccccaaaaaggcagttccggttggaggtaaaaaccttcgatatcggccgcctcgaaacaagctttaggaggacaccatgaatggaaacggcaatgattgataccgtattccttggcgatgcggaaatagcgtctccatgctgcggtatccatcggtacatggcctgtaagcggaaatacgcaagcatcgtgttttccacgaaggaaggtggtcaatccgttgatgttgaattgtgttccttctgctttgaaatctcttaatccgaaagtagtactttggctatcttggatattctctccttggatgttcgcggtcaagcgatacagggtaggggagaactcgctccattccaaggcgtcatcacccatcggtatttggaatatgatctcgtcttgttgaactacgatattcttattgaatttgatatggtgctctaagcctgtgttgaaagcctccatctctatttgaacggcggctacgatcatttgctcgaatggatttgaaagctttatttttacgtccaccgttttttgatccgcatgtggatatacttgtatccggcggatatggaattgtggacgggcttccaatttcaggtctccgataataccgttccagtttgtctgcgtggattccgtataagcgtgtgaattgtccaataattggggtggaacgctcaaaccgttatcgactagaatagtcaagtgatgcttcccagcccggagatatgtggacagatcgtattcttgaggggtggaaatatggtcggatgaaccgacatatatgctatctacccatatttgggtcggttttgttcgctccaagattaaccaaatgctcttgccttcccaattctctggaatcgtgatctctttctgataccaagccttaccttgatagcggaagggcctagacaaatgagttgtctcctccttatcattgttagggtatcctttttggttggtgtccgtggtacccggtaattgaacttgctcggtgacatctgttgaatccaatcgtaattcccagcaaccggcaagcgataattcctctctactctctttgggagtttggcatgcgaatagcatgagcataagtggaatactccaaaatctcttcatggtaatgtttttactctaaatagggtttactcaattaacagtggacaaaggtagtattttcgtgggttatttgttctatgttcgtgaatttatggagaaattaatgtatagaattgagatctatcggactagcttgcgttccaatactataaaagtgatttgttaggattggaaagcggtaagggtcatttgttggaacgatgattcctgtaccgccattggtctcggatacttcgccgtcgggggataaccttactttatgagtatataaaggtgtcccgctcgcgtctactagtacgacttgcaatgtgtaatctttatccgtgggaacgggggcgggtatagggagaatataagaacctttaatcgtggttccaccagttacaaacgcactcttgggtatatttacgataatcttatcgttcggatcggaactcatcggccccatgatataatcatttgaatctcgtttgatcaaagggacgcttttgttctgtatcgtatataattcgatatgtaaggcgcttacgtctacgccccctatttgagtggggatgttcttgaaataaccgataacaccagctacacgacggtatagatctacgtgtccggtacctccgttcaagatatttgtggttaaccgggagaaaccggcgaaaagctcagaaccggtgatatccgtacgaccttttcccgccgctagtaaagcgttggcatcctttaataaggtacctgaggtaggattggcttgaatcgcattgggcaagccgtaagtcgccccggaggtgtcgtctaagccgattgccaagaatgtatatactttcgatgcttggaagccctcgtatacaactttataggtctgctctttggtggagaggccattatccgctccagtcgcatattgccagtttatattctcggaggctacgcagcgagcgttgtctgtagccccatcgaaaatataaagctgaacttgccggacatgttgcaaattgtcgggactggtcaatacggtgcgggtcatcaatgccggagaggcattgaagataagtacgaccgactctttgttgcttcccggaactgacgggtccggtagatcctcgttactgcatcctacccaagagagtagtaatagggaactgattagtcggcataactttgtgtatggcgatgtgcttatatcgatagctttcttcatttctttaatagtttgaaagttttagaatttggggtgtttcgtcttggatatataccttgattaggttgattcccggggatagacgaagctgatattcgtctgccggataagaaaccgagtctattagttgaccattgacggtgtaaatctcgcagcgagtcattacgacggctgtggaacgtatgattacttggttggttccttcccgatagcaatagaccttgttctcggtggatatatcgctttcgttggctgtgaccgtaccatttgtcagatagaaacgtccgatgttggtggagagagtacctagatctatttttatatccggattatccagtgagtaccgtttgttcttctccacatcgaacaaactccaaccggtccactctcctcctaaagctttgcgtacggataaacttacttcagcgggaatgcgtaagtagaaaccgagctgtatctccgtggcgttctgaagctgttggatatccaacgcttttccgtttgccacgctaaaaatggcgatcgctgggcgtatttcgttatcaataaggagctctgcatcttctcccgcgacatatttattatcagaggccggattgaaccgtagcaatgcattgcttaccgcttggcttgtggtggcagtcagataaagagcggatggatcctcttggatagaggagtctgcgcttttcaatttattgtccggtccgggtgcggatactaacatagactctgtatatttgatggtctggctagtagccgccgatgctacggagataaagaaagattgcataggcgctatccgggtgtaacctgctccgttattcaataattgtccgttggcattaatattggagttattactatttccatcatatacttgtacggactttacggcagggttttgattcatgaattccgagatatccagatgagacatgaacatattgccagccaagaaataagtaccagcctgcttattggtcaacgtaactgagatcgggaaagagacgccttgggtactattctcgtaaatgaaacgtcctatacttgagcgggtaatagtctctttgattcccgttccttgattgctggtatttacgtattcatattcagtatgctctttgggaaaacggaaggtgagcgggaggcttgccgatccttgctcggctttcaaagagaagccttttcccatttcatagacttgcgccagcgcattgaatggctgtgtccattgggtttctgtgggtgtgaccgttacttgtccgttgttcagtgtttgtccctttgcgtcgctcgcccatagacgttggtagatacgaggattgaatcggttttgcgaggtattacttgcgttgagcgaggtgaatggagatggatttcccactacagggataaacatatctccggtgaccatactttttaagggagcagatagcatataataacgttccggcgttaaagtaaggtctacccatgccttttgatagatcaataaatgggtgtttgtaacttcaccccctgattcgaagtaaatgttattgcatccgttttgctctacactggtaagggtcgggtagatgttacagttagcggggatcgtaacattggtacaagtccatggagagccattcgtccagttgttccagttattccaattggagttttccggactgactttccaagtggtatttaaaggatgtacctcgaaaaatggattggagacgatcttgcctttcttgtcttgaacaataaggttgaattgcccggccacggatatcggaccgatcacccagctaaaagtaccatcgctagcggtgattgaatagctggccccgtttatgcctaggggtgtacaagatagtgtatagctattgcccataatgcctttgccagtgactgtaatgctactgctttggcagatcggactgatattcacgttcacaagatctgtctgatcgttggggcatgatatctcatcgatacaatcaggtataccgtctccatcgatatcattacggaagaacaggccgtatagtttcatattgttcaagagatctacggctccgttaaccgtgatccgtatctcgtcgaattgagcatgcgggcgcatggttagatactccttatctccatagccgatagcatctaatcccagtacgctccagtttgtaagtacttcaccggtagcggtacctttataataggtagatagggtcatccaacttcctacagatactccagctaaatatgtggccttgtcgatgatcaatccaatattatgagtggcgttgagtacgcctccgactttcacggctatgttaacggatgacgcaactccgattccaccgatggaggtataggtggtaggatcgttatcaatcagatttgcaaggttcagtatcgtaccgccaacactcgcaagagcattgatccctgtgtaggcgtagttgatacttgccccagtcttatcggttgatatcatagtcgtgctacaacctatcggattatcgtagcaattcaagctggccggttctacgaatgcaccataaatacgtaaagtggaaagatcggtagaaagcacaccgcttttccataaagttatttcgttgaaactcttatctgctggcactataatgctataacggacttttagcgagccatcacctccgatcacgcctgccgatattacatttgaattatctattactttctcgtaggttttagtctggttattatatactcttatctggaaaaattggagaaggttggcgctcaataaagtggaactggtctctacaacgaacccgactcttttcgacgtgccatcactgaatgtcccgctatttttctttacacctataatctgcaagttatccacaagatttaggcctccggtatattcggcgtaggtactcatgctggcatcaataatattctctttatggcttatattgcttagagagatcaaacttccgcttgattcgttaatttttgtagatagagatacatcggtcacgggctggttacatccgtttgagacggttgtctgtatgccttttgtaattgtcactagtccgctatcaccacctgaggcggttgcccggaatacgtagtcaccggttactccggcagtcatattcgtaacttttccggtggatgagactgctacgttctctcccgtgggttggcttacgacttcccattttgtgatatcgctatttcctgtaagttggtaagtggtttggtcggcgcatattgttgtatttacggtcaatccgaagttatgatgatgagtaactttcaatggttcatagatgtagccataatagactgattttacatttgtacttaaaacactcgcaaaagttagcctagctttgttaaatgcttggcctgctatgaccgaaacttgaacgaccccttgtgagagaacgccgagccccaatactgaaggctcgaaagtcgtagttgatgtgtttcctttgctatcggttaacgtaagtgtggtagtggctagtagatttatgtttaagataccagtatctttgtatttaaatccgacttctgtgcctgctggataatcacttgtccaagataattcaacataggtagaaccaacgggggaacctaccacggaaaaatctgttaagtccgcattaataagcctactggtattagtagcgcctacagttgatccggttacactcagccctgctatcgagttattggtagtcaaagtcttctctacggcatctcccacgaaagcgtatctgatctttaactcgccgagagcggctacacctactccggtattgataagtccgacttcgtcaaaatctttggtggacgtaacggtaagataggatacggcctcctgttgccccggtagttgtatcaagtgaaggctgagagcgctggtattttgtccttctttaactagaattgtttcttgtaagacccctcctttatagagcataatacctatacctttcaatacatctaaagataggatactactatttcctcctgcttggatacagaaaccggctgtagtaccggcggggtatacgtttttaaggtccttgattcgtacgacgggtcctacggctacatcgactccggctacaccactaaatgttgcgtaattgtttaagttctcatccagcaaataatccatatttgtcacgccggaagctactttcgctacgtttattaaattgtttatcatacaatcgggagccactaatgctttacgggctaatccttcggccattcgtacgttgaacgctgataaaacgagcaggattattataggtatatattttctcatgatctatttaaactctggtaatgccggatatatgtcttgtattgcaaaaggaatagtgcgaagcggcttttatgccgcttcgtctattttattaagtttgtactctttctattcaacaactagtttgtggattaactcccagttatcatttacacgaagagtaatgatttgacctttgaaaagatcttcaggttcctctacctctccaccaccgggagtttcaggattgcttggtttggctatcgttttttctccgatagaatatagatgattacgtactaaactataactggaggttgactcattcgggatggtactattgtctatttgtaccacattagattgagtggccgctaagtttacggtccaatattttatgatcgtattgctattatctaataattgtaattctaatgtattcttgttttgattcgcaaatggtataacgaaattgctagcgaagacggttccctttttggcattgaaatctgcactcatggctgccggtattacccaagtcggagatatctctgttcctgcgtcttgatcatttaacaagccatcgtcattaacatccatcggtgttcctttaaaccagtcgcttaaattaatttcatagaggacagcggcgtcattggcacccgtggaattatggaatttagctgttgctgttgctggagttttaccgtttacgacatattttacattagcgcctcctgtttttctgaagctactgttgaaatttgtcatatccaattgagtgtttttaccagaggaaaccaaacgtagtttaacggcgtctttattgtctaccttggcgggaatattcttgaaatatccaaatacgccggcaacttggcgatgtagataaagcacgttgttagcgacattcgctgttaacgcaaaattccgattgttatcaacggtaatcttttggatagatccggcaaagatctcttcaccctctcctgcggttgtactcgtaacatgattgaatgtgcttgcgccagaccaacctttggcaatgtcagtaagagccggggcgtgtgtatagtttgatccggaggaggtataacccaccgcatatactaaataactcccggggtctaaaccggtattagctccgcttgtgatctcggttttgaggtttaatgtcgcatagcggccatgatccgccgaaccatcataagttgagccgttatatatgattccggaaggagaggaggcatcgctccactgagcatattccttatcatagacacaacctgtgatagcatcacttgcccctagagagaatatagccacctttactttgtcgattgtttgtgcggcctccgagctatatagcggacgtccagcctttgtcgtcagcccatcaccggtattagctacgcggagtactagttcttgccctaccggagaaccttggctcggatcatcctttggatcaccatcattactacatgcagagaacaagaacatgcctgtcgctgctaaacataaaaacttcttcatcgttttgaaaattaaagtgaaacattaattgttaattacagatttgtttagttgatcacgagaccgtgttgttgttcccagctgtcgtttaccaacatgtaaatcctgaaatctccgctatcatcatacacgtattttagtactgtcagttcattccttctcatagcgatatttatacctttgggtgtgagggctggaagatcgtgttgagcggtagcgtagaagtttagccttaacagcgaatattgatcttttccggatggtgccagcattgttttaatgacagtttcggacgccgttttccagtcagattgtttatagacggatgtagattctgaataattaaagtaacggtctactcgtttgaaaagactgtctattgagttctctgaatgaacgatcgcactcggcaagtttactaactgtacgattagcttaccttttgtacgttccatatttattgtataatgataattatcaacgttatatataagtgtatcattcgataggtaaagatcgtcaccctccttgttccctacatgtaatgtcgctttctctggatcatcttttaaagcagtctcatcggctaaacctccccataccgtaaatacatatttacctaacggcatattttcaggaaacgtgatttgaaatgtcttttcatcaccacttacgttaaatacattcttttgttcaactatatttcccgtattaaagtcgtataatgtataatgaagtgtcggtatatattctttaaacggcagattttcacctttgtgttcttcaagctctatgttatttatgttaaaatagttcttgtcttttacctctatatttatttgtaaaggaggacaaggtttcatgtcttcttttatgcaagatatacatagctataaaaatgtgaataaatatatgtaatttctagtattcatatttgacttgataaagtttagacgttttatataatcaacaggacagtatgatttaaagtttttgatacatcccgttatttttttattttttgaaaagattactaagtgataaatactgtattaaaaggctctatgttgatacgatttatgcggatttttataattttaagtatacactcttttatctctttttattataaggcatgaaccattggtaatgcttgcctgtttaatatctattattacgttaataaaatgaagaatatgaaaacaaatgattcaaaagcatccgtagactctaaattggaggagatggaggaaaagtatcccgtagagcaaatcgctgttaaaaatgagaagaaaataacggccaaggatataaaggaggctgtgaaagagattaatcccgatacggacagcttgggtagcagagggtaaaacgtattttaatttgctcaaaagaataattattaagatttatagtattatctttgcggttgcggttgtaataaaccgaggtataaagattggtaaatctagcaaattaaataataaagatgtatagaacaagaacttgtggcgacttgcgccttgcggatgaaggtctggtggttacactggccggttgggtgcagaaaacccgcaaaatgggaggaatgacatttgtcgatatccgcgaccgttatggtattactcagttggtatttaatcaagaggttgatgcagctctttgcgaaaaggcaaataagttgggccgtgaattcgtgattcaggttacgggtacggttcgtgagcgctccagcaagaatgcgcatatcccgacaggtgatattgagttgatcgtttctgaattaaatgtcctgaactctgcgcttacccctccgttcacgatcgaggaggagacagatggcggtgatgacttgcgtatgaaatatcgttatctggacttgcgtcgtgcttgcgttcgtaagaatctggaacttcgtcatagaatggcgttcgaggttcgccgctatttggatgagcaaggtttcttggaggtagagactccggttcttgtaaattctaccccggagggtgcccgtgacttcgtggttccttcccgtatgaacccgggacagttctacgctttgcctcagtctccacagaccttgaagcaattgttgatggtttccggtttcgaccgttatttccagatcgtaaaatgtttccgtgacgaggatttgcgtgcggatcgccagccggagttcacgcagatcgactgtgagatgagcttcgtggagcaagaggatgtcttgaatatgttcgagggcatggcgaaacatttgtttaaggtaatccgtggtgtcgagttcaaggagtcgtttatgcgtatgacttggcaagatgctatgaaacaatatggtagcgataaaccggatttgcgtttcggcatgaagttcgtcgagttgatggacatcatgaaaggccatggtttctccgtattcgataacgccgcttacatagggggtatctgtgcggaaggtgccgcaagctatacccgtaaacaactggatgcactgactgaattcgtgaaacgtccgcaggtaggtgctaaaggtttggtttacgctcgtgtggaagcggatggtaacgtaaaatcaagcgtagataaattctatagccaagaggttcttcaagaaatgaagaatgcgttcggcgctaagccgggtgatttgattttgatcctttccggcgacgatgtgatgaagactcgtaagcaactttgcgagttgcgtttagagatgggtaatcaattaggtcttcgtgacaaggataagttcgtttgcttgtgggtaatcgacttcccgctgttcgaatggaacgaggacgatcaacgtttctacgctatgcaccatccgtttacctctccgaatccggatgatataccgttgttggacacggatccgggcgctgttcgtgcgaatgcgtatgatatggttatcaatggtgttgaagtgggtggtggttctatccgtatccacgacagccaattacaggataagatgttcaagctgttaggattcaccgaagaaagagcgcaagagcaattcggtttcttgatgaatgcgttcaagtacggagcgcctcctcatggaggtttggcttatggcttggatcgtttcgtgtctttgttcgccggtttggattctatccgcgactgtatcgctttcccgaagaacaattccggacgagatgttatgctcgatgctccgggtgtcttggatccagcccagttggatgaactgaatttgatcgttgatatcaagaaataatccaatctgaaattccattcgaatgggaatcttattccatccgaatggaattttcttttcttccgaaaggaattactttttctcccgaacataaatcaaaggatatttagcatggtaaaggttaaagatatattgagagaaatagagcattacgccccgctgccgcttcaagaaggttttgacaatgcgggtgtgcaagttggcgacgtgaaccagcatgcgacgggtgtgttgctatgcctagatgttaccgaggaggtgctcgatgaagcgatcgagatgggatgcaacctgatcatctctcatcatcctttggcctttaagtcgtttaagtcgttgacaggctccaattatatcgagcgttgcatgatgaaggcgtgtaagtatgatttggtggtttatgccgcccataccaatcttgataatgccgtaggaggcgtgaattaccgtttggcagagttgataggcttgcaaaatgtacggatcttgagcccccaaaaaggcgctttgttgaagttggtgacgtttgtccccgaggcttatgccgagatcatgcggaataccttgttcaatgccggtgcgggaagtatcgggaactatgatgcttgcagttataatttacatggcgagggaacattccgtgccaatgcgggatgcaatccgttttgtggtgagatcggcgaggtgcatgtagagaaagaggtgcgtatggagatgatccttccggcattcaagaagacagcggtgacccgtgctctgttatccgttcacccgtatgaggagccggcttttgatttttattcgttatcaaacacatgggaacaggcaggttccggtgtagtgggagagttgcctgccgaggaagatgagttaagtttcttgttacggatcaaggccctgtttaacgtcggttgcgtgaagcattccccatttacgggtaagtctatccgagaggtcgctatctgcggaggcagcggcgctttcttgatcaaggacgctatcgcatatggtgccgatgtctttataacgggggaggcgaagtacaacgatttttacgatgtggaggaccagattctactggcggttatcggtcattatgaatcggaaatctgtacaaaagacatattttataacataatatcgaaaaaattccctacctttgcggtacatttttcgaatgttaattcaaacccagtaaaatatttatagaatggctacagataaacaatcagctgaaaaggaatatacggttgaagaaaagctttctacgctgtatcaacttcagacgatgatgactgaaattgataagatcaagacccttcgtggtgagcttcctctggaggttcaagacttggaggacgagatcgcaggactggaaacacgtctccagaactatcaagcggagatcaaggagtttgagacttctgttgttgagcaaaagcataagatcacggaatctaccacattgatagatcgctataaggcacaattagataatgtgcgtaataaccgggagtttgataacctgtctaaggagatcgagttccaaggtttggaaattgagttctcagagaaaaaaattcgtgaattcggagaggcggtagacgctaagaaaaaagatatcgctgaactgactgagaagctggaaggccgtaaggctgacttggttcagaaaaagagtgagttggagcagatcatttccgagacaaagcaggatgaggagaaacttcgtgagaaagcgaagaagctggaagccgctatcgaacctcgtttgttgaccgctttcaagcgtatccgtaaaggtgctcgtaacggtttggctgttgtttatgtgcaacgtggcgcttgcggtggttgctttaacaagatcccgcctcagaagcaattggatatcaagttgcgtaagaaaattattgtttgcgaatactgtggtcgtattatgatcgacccggaattagcaggtgtagaagattaattcaaaagatctataagtaatggctctagctaaaaccggctagggccattattgtttttaatacaaagatgttatgatacatacgatacgtttatatatagagaagtaccggctgttatccgaggatcgtccggttttggtcggattgagcggtggtgccgattctgtggctttgttgggcgtattggtgcgtttgggatatccgtgtatagcgcttcattgtaactttcatttgcgtggggaggagtcggatcgggatgaggcatttgcctgtgagttcgcggaatctttggaagtaccctttcataagatagatttcgatacgatctcttatgccggagagaagcatctctcgatagagatggctgcccgtgaattgcgctatgcttggtttgaggagatgcgggagcggcagggagggcaggcgatcgccgtcgcccatcaccgggacgataatgtggagacggtcttgatgaatttgatacggggcacgggaatccgggggatgagcgggatccgtccgaggaatggtttcatcgtccgtcctttgctgtgcgtaagccgtgaggatatcttggcttggttggcggatcaaggctacgcctatatggtggatagcacgaatttatcggatgcttatacccgtaatttcatccgtttgaatgtgttgccgcttttggaggagataaatccatcggcccggaataccatcgcacgttccgccgagcatctttctgccgcagagactatatatatatatgtattggaacaagcccggaaagaggttgtcgtatcggatgatcgtttttctatcggggcgttgatgcggtttccggctccggagacgattttgtatgagttattaaaagaatatggttttacccgtctggtctcggacgatattttcgctgccttgaccaaggagcccggtaagctgttttactcttccacccatcgtttgctgaaggatcgggattatttatggatcactcctttagagaagaaggaagagcgaaccttcgttttagatccggaaaagggtattaatcatgaacctattgaactatctttccaaaaacttgttataactataggtttccctatcgagaagaataagcggatcgcttatttggattatgataaactcgatttccctttaacattgcggacttggaaagaaggcgattggtttattcccttcggaatgaaaggacgtaagaagttgagtgactatttctccgatcataaatttagccggattgagaaggagcgcacatggcttctttgtagtggcgacgctatcgtttgggtggtaggagaaaggactgataatcgttttcgtatagacgaatcaacaaagcgtgtgctaattgtgaattttttgggctaaatcctcgtttattgtaaaaatattcttacatttgcgaagatttactccgcagatatgttactaatggttcaaattagctgaacaatccggttattacatgaaaattataattaaataaagatacaatgataccattgggcgtacatcgtgtttgtatatgtgatccgtgtgtatgtaccatttatattattactttgcaatatgcagaaatataacattctagaactaaatgaaaaacttcttcccgaacttcaaagtatcgcggaagagttgggaataaaaaaagttagcagcttaaagaaagaagagttggtttatcggattcttgatgagcaagcgatctcctatgccggcatccaggctgaaaagatgaaagagaaagaggctaagaagcctgcagagggccgtaagagaggccgtccggccaaatctcctaaagtggcgaaggctgagactgccgaaactgcagagagtacccaacaggctccggaaaagctagtgactgctccggctgacaagaaagagcaaaaagagcagcctgaacgtaagaaaagagtccgtatcgagaaaaaggaaaaggtagcgggcgctatcgctccttccgaggataacaaggaagtggtggtttcgaaagagccgcaaacgatctctacggtaacggaaatctcggccgtggaaactccggcggtagcagagagcccggtggagaaaccgttgttgcctcctgttgtggcggaacttgaaacggaagaagaagccgctttgccggaaaatacgactcctgtagaggtagcggaagaaaccacttctccacaagcgacagaagaagagcctaagcgcatcgtattccgccatccggacgctaaatccgtattggatcaaattttcccgttctccgctccgaaacccgaggctaacaaacctcaacccgaggccgctccccagcagaataatcctcgacagaacaatcgacagaataatcataataacaaccgtaataacaataacgctaataacaaccagcaggctcaagagaaaatgtatgagtttgatggcatccttacaggaaccggcgtgttggagatgatgcaagatggttacggtttccttcgttcttcagattataactatttgacttcaccggacgatatttatgtctctcaatcccagatcaagttatttggcttgaaaacgggtgacgtggtagaaggttcgatccgtccgccgaaggaaggtgagaagtatttcccgttggtgaaagtggacaagatcaatggacgtacgccggaagaggttcgcgaccgggttccttttgatcatttgaccccgttattcccggatgagaaattcatgcttacggcacgtaaatcaccgaaagtatacgataatatcgccgtacgtgtggttgatttattctccccgatcggaaaagggcaacgtggtttgatcgtcgctcaaccgaaaaccggtaagacgatgttgttgaaagatatcgcgaacgctatcgcttacaaccatcccgaggtttatatgattatattattgatcgacgaacgtccggaggaggttacggatatggctcgtagcgtggatgcggaagtgatcgcttctacattcgacgaaccggctgaacgtcacgtgaaaatcgctgagatcgtattgaacaaggcgaaacgaatggtagaatgtggtcatgatgtcgtgattcttctggactcgatcactcgtttggctcgtgcttataatacggtacaaccggcttccggtaaggtgctttccggtggtgtggacgcaaatgcgttgcagaagccgaagcgtttcttcggtgccgcccgtaatattgagaatggcggtagccttacgattctagccaccgcccttacggagactggctctaagatggacgacgtgatcttcgaggaattcaagggtacgggtaatatggagttacaattggatcgtaaattatccaataaacgtatctatccagctgtggatatcacggcttccagcactcgccgtgatgatttattgcaggatgagagcacgttgaaccgtatgtgggtcttacgcaaatatctatcagacatgaactctatggaggctatggaatttgttaagcaacggatggaacaaaccgttgataatatggaattcttggcatccatgaacggttgataatatcccataaaaaaacactatacttttgagttcaaagcaatattgttttagctccaaaagtatagtgtttttctattaaaaagtatagtgcttttattgcacctttttaggtcttccacgatgtcccatatttcgtttttgtgggctcgaggatgatcttttatcttcacttttacgaggccgtcctctgcctcttttattcataccgtatttttccggctcatacaagggcacttcgccgaattccgggctgaccggtatcttataaacctctttttccaagaaatcctctatgcgcttgaattgtgcttgttcgtcgatcgatacgaaagtaatcgccaatccttcgccgttcgtaccccgtgccgtacgtccgattcggtgtacgtaatcctccggatcatgcgggatatcgaagttcacgaccaacttgatgtcattgatatcaattccacgtgctacgacatccgtagccacaaggatatcgatatgtccgctcttgaattctttcatgacctcctccctttgggattgctctagatccgagtgcatggcggctacattgaactttaatctttttaaggtagacgctaattctttcaccttcattttagaagaggagaagataattacccgttgagggcggctttgagtgaagagatcttgtagaatcttgagcttttgtggatcgtagcagatatatgcggtttgcatgatagattcgggtgggcgtgagatagcgatcttgacttcttccggatcttttaggatggttttagccaacgtccggatcttaggcggcatggtagccgagaacatgatcgtctggcagtaggggggcagctgtttatgaacctgcatgatgtcgtcataaaaacccatatccagcatgcggtccgcctcgtctaagacgaagaacgacactttagacaaatctacagtacctaacttaatatgggacaataaacgtcccggggtagcgatcacgatatccgcacccatctctaaacctctcttttgttgttcccaagcgattccgtcggtacctccatacacggctactgcggatacggaaggtataaaataagtgaatccttgaatttgttggtctatttgttgagccaattcccgggtcggtgccataatgaccgcattcaccgcgtctgtcggatgacaacctttgcttagttcattaataactggtaaaacatatgccgccgttttaccggttccggtctgtgcgcaagcgatgatgtctttaccttctaaaatgacaggaatcgttaactcttggactggagtcgtttcgtcaaaattcatgtcataaagcccgtctaatacggcatcttccaaatctaattcatcaaatctcatctttttacattcaaattcccggtaaagataaagattatttagaaatattatgcaataggtaggtttctctttggtgataaatagaaaaataaatacctttatccccgagttataccccaaaaacgaaagaattaatatgaatagtctagaaagcggaagtaacgttcagtctggattagagatgatcatggagaagagtcccgatacgatcgtattagtagatcgaaatcttactcttgtcaaggttatttctgcaaaagacgattattatcattatttagcgaataactgtatcggaaagcaacctcaagcgttgttcccggacgggaagaactacgatcaatatgagatctatagagctgcggttaaacgtgttttcgaggagcaagtgaaagtggatttctcttttgaggtctcttttgaaggaaagaactattattatctatcgcaagcaagcctttttaatgaggagcttgtgatcgtttatacgtgcgatgtatcttctctgaaaacagaaaaaaatctacaagaactgatcaatacgatattagatcggttaccgttgggtgttttcgtgaaagatggggataaccattttaattacctgtattggaatcattttatggaggaaataacgggtattgaaacccgggagatcgagggacatgatgatttcgaggtgaattataatgccttgatgaccgccgaggagcgtctggaaaccgatatgaatgtgatcaagacaggactgaccgctagatttaagggcaaggtaaaatcggcctccggcgattaccgggatatagaggtcgctaaatatcctatttccctaaataatggcaagccgcttgtcttggctttatggagagatataacttccgagttggctacggagaatactttgagaagaacccggatcttgacgaaaatggcattgcggataagtgatatacgtacatgctcgatcttcatcgatccggacagtacccataatttcaaggattccgttgtgaccttgaacgattggaataccatgtcggaagatatgatagaggtgtcatgggggcagtttatcagccgggcgcatccggatgatcaagaacattatcataatatgtttacccgtctttgccgaggggaaatctctgaggcaaggatcgaggcacgtatgctatttcccggcaagaaggaatatgtttggagagaggtattcgctaccgtgtatgaacgggacgataaaggaagaccttcggttatccttggatgttcaacgaatattcaggaacggaagaatcaagaattaagccttgaggaggcgaaggtgaaggctgaggccgctgataagatgaaatcgaaatatctggcggatatgagccatgagatccggactcctttgaatgcgattaccggtttctctgaattgatggcttttgctgatacggatgaggaacgtatgtcgtactacgatgtgatcaagatgaataaccaattgttgatgcaattgatcaatgacatcttggatatctcgaagatcgaggcggatgcgataaagatcacatatgagcaattagatgtcagtgaattgatggatacgatttatgcttccgccaagttacgggttccgggaggagtcaagttggttttggagaaagaggctgaccaccatatgttcggtacggatagcatgcgtctgttgcagttgattaataatttggtgaacaacgctatcaagaacacgaaagaaggtagcatcacgatgggatataccattcaaccggatgatcaattacgtttttacgtaagggatacgggaatcggcatcgataaggaaaaattgaaagatgtcttcgaccgtttcgtgaaaataaacgactatatggaaggaatcggattaggactggctatctgcaaaggattggttgtgaagatgggaggttcgatacatgttacgtctgaattaggggtgggttcggagttctcctttattttgccgtctcatgaatagccctatttgtaatagcgcttataaatctggtcgtataatccactgtctttgatttgctggagccaactatttaggctatccagtaggacaggagagtctttacggaccgcccacgattgcaattgggtaaaactgacatccgttaggatatcgacttccggcagttttttctgggtcatgcgggcgatttgttggtcgcatacggcataatcgatatcgcctttggctaccatgatcataagctgctcggtagaatataactcatcttccaccacgtagatcgtatcgcctatctcgtgtcccagattttgcagacgcaataaggccggggaatctttcggtatgtataaagtcttttgggctaaatccaattggttacggataggggcttgtccgttgttcgcctctgccgtacgttgtaccaagacttgcttgttgagaacgatcggttcggtgaacaggtagttttcccgcatctcggaggtgatgggtatgtttcttgcgattacgtcgcatttgttgtccgataattcctcgaagcttttcgctaaactcatttccaaatgcgtctgaacctccaatccggataatttagcgatcgcttggctaagctcgtattgaaaaccttgcaccgtatcgccggatacgaaatatccggattgattgtactcggttatcatccgaagaattccttcttccttgatttccggataatcacgaggtccgatctcttggggacgttggttaagtctccaaagctgtaccattgtcactacagcgacaatcagtagaaaagcgtataggataagcaacttcttagatctcatggcaatcgattaattattgaaagtcacggagatacccattttcaagaccatcgggtccaacggataatgcgcaagagagaagtaattcgggtcaacgaacttagagcctagattgtatgccatgatgaagaagcgagcttgcttcaaatggaaattcgcataagcgttgatcaacggataattaccgaccttcactttcttgtcttcttcctgtacttggaactgctgggtagccggctcgtaataaggagcgtaataagcggtgttgtagtatacgttcgcgccaatctgtacggttaatactttcgccaacttaaacgctagatatatattcgagtatgcgctgatatccggcaacggaagttgagacttctcgctagaaagctgataggccacctcattctcccatccgaacgcacgatacatgatatcttgcttgatacgggctgagacaacttggatgttcttactgctttgctccggcaaacctttgccgttgaagaatacataattctggatactttccactcctccggataactgggtacgggtggattccaagttgattttcgctccggcgtaaatcctttgcacatttttcaatgatagatcccaccaatagtaacgcccatgatggtgacgttggtagaacgccggggtgatgttcttgatgtatccttccgccttgatcgtagcgtctttcttaaaaagtttgaattttgtttgcaggtctccgctcactcggacctctccggcgtcacttcccgcaagtcctaattctccacggacattgtaggtaagaaggctaccacggcgtttggataattcgccgccgatgtaggtagtaaactcatcatatacttcggaagtagggaaatttaatgtgcttggctcagagcttccatgaccatccggaccgtagtccagtccgggaacttgggatgccaatctaaaccggcgtttctcgaaagtaacgaaggcggtcagcccgaacttagcccaatcttggaaaccttcccgcaaggccaacgcaaaggtattctttaaattccaagaggaagtctggtcattcaaagatgcgtccataccataaagatgagtgtagcaggtatcgatcccggcatcattagagataaagcgtctgcggttatcttcgtaatcgatggtatggatgatactggaaaccggaatgaatacctcttttacgttcccttcctcatcggtttcttccaattccttagtaaaaccgagattgtatctctgtgtcaggaaatattgttttccacggacacggttccatgtgtccgtgtaacggacagggtatgatttactatcgatatttctttgattctcggccaagtcatcgggattcgtgatatactggtcatttgtaagtccaccgttctcgtagtttacgaaattgaaattacttaaataagcgtttaactcgtaacggtcggtgatataacttccgaaaaaacgataacttaataatttattaccgttggagttataatatccgcggctatagatataatccatctcgccaccgacattgatctttttgccaaagttcatggtcaatacccctttcagtcggtccatcttattctggctggctcctcctgtcgtataagtcacttgggtatagggtactttggtatcgtagaaataagcgtttgttggggttgtgatataataatcataggcatcggcgaagatgaaatcacgttcctccttacgttcgttaaaaatacgggtttgcgccggcgatcccacattcgccagataacctacggccaatgagttcgcttccaccaacgtactattcccgaaatttaatcgattggtatccataggagcgatataacgttctcccaaaagaggcgtgagccgataaccgatgattcgttttgatttcagcgccgcgctatctgtttgcagcaagctatccggtatttccttgtttgaggatgataaattagataacgagaatccacctcgtcctccccggctcccggaacgtccttgcgcatgcgcggaagccgccgttcctatcagaaaaagtaatatgtatagataatacttcatgggttgcaaatatataacaaaaaataatgtgccaattataaaatatgccaatatgccaatcagaaaacttaattggcatatcggcacatcaatgaatgagcttcttatattttctgtataatctccattcctttcttaatggcagcctcgttcatcggcaacaaatgatggtgacgctcgggcaaggatttcttcaatcctagcatgacgttctccaattgaaccatcgggacgatattaagcaacccgcctaagatcaacatattgaatgccttctcgttcttcatctcggtagcggcgtccatggcatctacccgatatacgttaatatccgtacgtttcgctggcgtatggatgccataaccatcgtaaatcaagataccgcccggtttcaccttgctctcgaacttatccatggaaggttggttcaagataatagcgatatcatattcattcaatacgggtgagctgatacgctcgtcgctcaagataacggttacgttggccgtaccgccacgttgctcaggtccgtatgaaggcatccagctaacctccttgccttccatcaaaccggaataggccaagatcttacccatagacaatacaccttgtccaccgaagcctgctataattatttcttgtttcattgtcgtttaccgtattacttattcaacattctttaagtcgcccagcgggtagaaagggaacatgttcgcttccatccatttattggctttttccggagtcatcttccagccggatgagcaagtggagacgaactctaccacagaagtacccttaccggccatagcgttctcgaaagccttacgaagcatcttcttcgctttccgtacggctgcggccgtctgtacgctttggcgtgttaccaagcaagttccttccaattgggctaataaatcaccgatcttcagcgggtaaccgttcaaggcgatgttgcgtccgtaaggacaggtagccgtgggcataccttccagtgtagtcggagccatctgtccgccggtcataccatagatcgcgttatttacgaatacgatcacgatattctcgccacggttggctgcatgaatcgtctcggccgtaccgatagccgccaagtcaccatctccttgatacgtgaataccatcttctccggattcaagcgtttaacagcagaagctatggctggcgcacgtccgtgggctgcctcgatccaatcgatatccaagtagttatatgcgaatacggcacatcccacgggggagataccgattgtcttatcttccagacccatatcggctataacctcggcgattaacttatgtatcacaccgtggctgcaaccggggcagtagtgcatgggattttcattcatcaatctgggcttttcatacaccagattttccggtttaattatatcgttgagttccataatctttaattattaatgtatatatcttaagacatattgcaccagccgcaatacgatcgccgccccgccacaatacaagaatacggccttatcgctaacagcgaagtaacataccacggcagctatggccagtagcataaaaaccagcgtcaatatctcgtcagctttacttcctcgtgtcatacggatcagaataatttttccttcagcgcgttcaatacctcatccggggtgaatacgattccacccaatcggccaaagtgctctaccttcaccttaccatttacggctaggcgaacgtcctctaccatctgtccggcgttcaactcaaccgataacataccttttaccttatccgcataagcggcgatcacttttgtcgggaacggccataacgtgatcgggcgtaacaagccaagcttgataccttccgcacgggcgatctcgactaccttctggcaaatacgggcggaagaaccgaacgcgatcaatagataatcagcgtcctcacattggaactcctcgtaacgaacctcgttttcctcgatcttgcgatatttcgcttggaaacgaatattgttctcttccatcttcgccgggtctagctccaaggaggtgatgacgttacctttgcgtccgcccttctttccttgtacggcccaaggacattgagcgataatctcttcctcggtacggcggggttgatagggaggcaataccaccttctccatcatctgtccgatgataccgtccgccaaaataatagcggggttattgtatttgaaagccagatcaaaaccaaggcctacgaaatcggccatctcctgtacggaagagggagctaaggttatcaagcggtaatcgccatgaccaccgcctttcacggtctggaaataatcagcctgactcggctggatcgttcctaatccgggaccgccacgcataacgttcacgatcagacaaggaagctccgctcctgcgatataagagataccttcttgtttcaagctcacgcccggactggaagaagaggtcatcactttctttccagtgccggctccgccgtataccatattaatagcggctacctcgctctccgcttgtaagactaccatgccggtcttttcccacggcatctctgccataagggtttccaatatctccgactgcggagtgatcggatagccgaagtaaccgtccacgccatagcggatagccgcatgggcgatggcctcgttacccttcattaattttatatcttctgccatatcttgatataactttatatttttactttgtagatcgttagacaaccgtccggacaaactaacccgcaactagcgcaaccgatgcatgcgtccgggttcttcatgtacacatagtgataccccttgttgtttacttctcgtgggtgcaactccagcacatccgacgggcaggctactacgcaaaggttgcatcccttgcagcgctctgtgtttacaacaacagctccttttattttcgccataatacttgtttatttaaaatctaaatgtaacacatttctattgaggcatcaaagttagtaaaaaattactcgttgccaagattataacgtttcattttgttgaatagcgtctttctactgatatttaacacctcggcgactagggtacggttatagttacttttgatacttctttatcactttattagtatagagaggatttcgcttattggaaaagtacgatgtgcgatgataaaatgtaggcaaataagaatgggcattctaatcaccttataatgcccattgtaatattgggttacgccttagtgcttttttgtgagagcttttctaggaaatatacgatcccgaaacctaagatcatcaatccgacggcctcccaaacaaactgattcggagcgatattcgcctcaaccaacggcttggtcatgccatggctatccacataggtctcgatcgtttctttccaaggccataccttgttaagcgaacccaacatgaatccggccaatacggcgatcgttatatcatggaatttacgaagggcgaatgacaacacgcgggagaacgtcgtgataccaatagccgcacccgctataaacaccaacataacgggaacgttaaacgtcttgaccgcctccatgatatagaagtattttccgagcaacaccaagataaagctacccgagatacccggcaagatcatggcgcaaatagcgatcgccccacagaggaaaataaagagtaaattactcggagtctcggcgggagtcgccacggtgatataaaaagcgatcaccgccccgacaacaaaactcaagatcgtcttccagttccattgcctgatatccttagagacgaaccaagtagaggccagcaccaaaccaaagaaaaaagaccataccaagatcggatgatacaccaagagatacgtaatgatcttcgccagcgagaatatactaataccaataccacccacgatagaaagcaagaaattagcgttgatccctttccagaaggccgctattttccccgtgaataattgtttcaatgtcgtcccgttaatacttttgatagagtcgatcagttcctcgtagatacctacgataaaggcgatcgttcctcccgacacgccgggaacgacatccgccgctcccatacccataccttttaatactaaaaaaccgtagtccttgagatttcgtttgttaggcatattacattattaattgtctaattactgttatctttattctttaaaaactcttttaccagatcctcgggttggatatgtttcttctctttatcggaatcgatggtaaagtctgcgaatacttctggtcccactttacgaagcaaataaagaagatcatctccggatatttggccgatatgctccatgaaattttccatatcacggttatccagataagccatagccaaatggatatgaatcattggagtcttcgggttgatttgaaggactttcttgtaataagagatcgccttatctacatctcccttagaaagcaaatattgtccggcatgaagcaggctgttgcattcttcttgagtttccggattgatgcttttcttatcgatgatcttgaatatcttattcgtaatagcgatagcctcctcctttttcccgctatcaagcaagcaaagcgctaaaagagaaaggagacggacattgttcggatacaattgcgccgccttgaataacatgatggaagcctcgttgtcgcgctcagtctcggtacaacaacggatataattgatataattggtcggcccatcctccatatccggatcgtttatgatcgtggaaagcagttggtaagccttctcatattgctccagcttcatataacattccgccatgagtggagagatacggcgcatcacctcctcatcaccctcgatttcttgatattcctcgatcgccttctcatagctctcgttcatatacaggcagtacgctttcaatattttcagttccgtatcggaatcatcacacgtcaaggcgaagtcgaaagcctcgatcgctttctcgtaatcgccaaccatggaatgtagccttcccagcgtaaaccaatactcgtatgagaaaggattcttatcgattagctcattacataactcgatcgcccggggaacgtctccttccgtctcgaggatgtagcaaagttcattcttaaggatcaagttatccggaaataaagccaagccacggtccacgaaatcgcgggcctctttgttcatgtctaaatcattcaggatgggggagatgtactcgaagacttcctccaaatagtcacaatccctagtgatcaactcttccgtgatctccagaaccttgggatattggttgagcgagcaatagcattccatttttaacatatccagatcttggttatcagtctccgctatattctcgagcagagcgagagcgctctcataatcctcgttatacgcgaattgcctgcctttcttgatttgcaaggcggaattaccgggatgaagctttagcccgagggctaagacttcatcaaagtaagtataatcgttcgaatcttcaaagctgtccaacatttcatcgatttgatcagcgtcgaaataaggctccttaccctcttccttcgctgaaagataatgttgtaacaagcgtgagatatcgtcttttttcatttactattctttatttattaatcttgctccacgtgtcctttagccctacggtacggttgaataccaagttgtcgggggtggattcgctatctatgttgaaatagccgatacgctggaattgaaggtaggaaagcttgggcaaggtagccacgaacttctctacgtaacagtttttccggatctccaaggagttcgggttgatgatttccttcatcgcctctagcggggagcaattcttctcctcacggatagcggccaattcgtctctggggttctccaccttccaaaggcggtcgtataagcgtacttccgctttttggcaatgggcgcagcttacccagtgcaaggtaccttttactttacggttagcgtccggcataccgctgcgggtattcggatcgtattcgcaatatacctcggtaatctcaccgttctcgtctttcttacagcccgtacattttacgatataggcgttcttcagacgaacttcctgtcccggtgtcatccggaaatatttcttgggagcgtcttccatgaaatcctcacgttccatccacaactcacggctgaactcgatcgtatggctgccggcttccggatcttccgggttgttgatcgcttccagctcctcgacctgtccttccggatagttggtgataatcagtttcaccggattgatcacggcggatacacggatggcgcgggcattcagatcctcgcgtacggcgctttccagcaaggcgaactcgttcagggcgtcgtaagtcgtataaccgatcttgtcgatgaacttacggatagactccggagagtaaccccggcggcggaaaccgcagatggtcggcatacggggatcatcccagctgtttaccaagttctcttttaccaatgtaagcaggttacgcttgctcatcagtgtgtagcttaggttcaatttgttgaactcagtctgtcgggggcggttgtcgttcaagtcctcgccttcctttagccaatcgataaacaaatcatacagaggacggtgtacgacaaactccaaggtacacaaggaatgcgtcacgccctcgaagaaatcgctctgtccgtgggcgaagtcgtacatcggatacgctttccacgtcgtacccgtacgatggtgcggatggttaaccacccgatagatgatcggatcgcggaagtgcatgttcgggtttgccatgtcgatcttcgcgcgaagtaccatggcaccttccgctatctcacccgtgttcatcttcttgaagagagctaggctttcctcgatcggacggtcgcgatacgggctctcgatgcccggttgggtaggcgtgcccttttgctgggctatttgttcggatgtctgctcgtcaatatatgctttaccttcctcgatgaggcggatcgcgaaatcccacaattgctggaagtagtcggacgcgtaataaatatttccccactgatatcccagccattggatatcctccttgatcgcctccacgtattcctcatcctccttcgtcgggttcgtgtcgtcgaaacggaggttgcagataccgccatggcgttcagcgatgccgaaatctaggcaaatggcctttgcgtggccgatgtgaaggtatccgttgggctcgggcgggaaacgggtttgtacacgtcctccgttcttgccttccgctaaatctttctctacggctgcctcaatgaaattcaggttcttcttgccttcttcttcgtttgtattgatatcgctcatacttaaaaattgatagtttttcttcgaatggggcaaaggtagcgatttctttttaaaataggctgatgagcagggctatatttaggacggttaccatcgttcccagcagcaagaggaggatggtcgtagagcggctgttcgcgtagacacccatgaccttcttgctggaagtgaggtacacttgcgtgaagaccgtgatcggcaattgcacgctcaacaacatctgcgacaggatcaatcccttgaacggatcgccgatcaggaatatgatggccaaggcggggacgaacgatagcaggactcccagctttgagtgcaggtcggtatgattgtacgcctcgccatagaatccggcgaagatggaagccccggcgataccggatgtgatggtcgaggagatacccgccagtaatagggcggcggcgaaaatcaccccggcgttgtttcctacgaggggtaccaataactgttgcgcttggtccagctcgtctacggcgatgttttgcttgaagaaggtagaggcggccaagatgatcatcgccgagttgatcgcccagccgatcaccatggacaggagcgtgtcgtagaactcgtacttcagttgtttcttgatgaccgactcgtcctctaggttccattcccggctctgtatcacctccgagtgcaggaacaggttgtgaggcatcacgacggctcccagtacgctcatgatgatcagcatggagttctcggggaaggtgggtttcacccagcctaccacggcctgcccccagtctacgtcgaccaacgccagctcgtataggaacgagagcccgataatggacacgaacgtgatgatccagcgttcggtcttactatatgtattactgaatagcatggcgaggcatacgatggtgacgatcaccgctcccgccttgatcggcataccgaacagcatccggagggcgatggctccaccgagtatctcggcgagggaggtggatatgctggcgagcatggccgatcctaggatcgggcggcttagcatgcggggcatgtatttgttggtcgcctccgagaggcagaggccggtcacgatgccgaggtgggccacgttgtgctggataatgatcagcatgacggacgagaaggtgacgacccacaggagggcgtagccgaactcggagcccgcggcgagattcgtcgcccagttcccgggatcgataaagcctacggtgacaagtaatccggggccgatatattttagcaaatccaatgccccggagcgggggcggtggttgatcttcagtttgtctagtaagttcatgtttgtatggatacttttaaattaaaaaacagcgtaaagatacgaatagtttcgttgttacccaacggtggccggaaatacgttcgtacggccgatggcgggtatccgtacggctgtcctcttgtagctgcccggccgcgtgtccgcgtttatgcggatacggtaaacgagctacgggaatgtcaacacgaaggtagtctgccgctgggccggattgcttctcaacgcgatgctgccgccggacaagcgcatgatctgtcgtgagatggacagcccgataccgcttccgccttctttcgtggtgaagaacggcacgaatatatgctcggcttcctcgggggggatgatggggccgttgttcgtcacttctaggataacggcctcgttggggtcgcaatacgccttgaacaagataagcccgttttcttgctcgtgcccgatcgcttgcatggcgttcttcaagaggttcaagactacttgcgtgatcaggttctcgtcggcgtagacgatcaagtcctccggttccacgtcgatacggatggttatgttcgggtagttattgtggtggcgggccaaccgcgtgagccgttcggcgaacttattgacgtagaataaagagggctgaggcgtcggtatatgcgtaaacttacggtacgactcgacgaacgcgatcaggcttttcccagtagagctgattacctccaagccgccccgtatctcctcgtcgacattctggtggagggaaagcaaggtgtcgctcaaggaggtgataggggtgacggagttcatgatctcatgggtcaagacccgtgtcagccgtatccatgactcgatctccttatcgtccagctcgctgttgatatcattgatcgcgatgatgcggacgtgtttctcttggagcgtcatctcggagacacggaccgagagatgtaccgtgccccgctcgttgataaaggagatctgatgtttctcgccgggacgaacgtcgctgatgaggcgctctagattctcgtcgatacgtccgagctggcgggcatgggtaaagaccgtcaatcccagcagtcgcaaggcctcgttgtttgtctggaaaatattgcccttatcatcttctacgatgatacccgtattcacttggttcatgatcaactcgtaatatttctctttctggatcgcctcggctttcgcttgaaaaagtatctgggtgatgcggtttaaggagtcgctaaccagcttgtcgttggaggaacgcccccgggtagcgtatttgaaagcgtaatcgctattgtcgatcgcgtcgaacatgaaggctaccttttgcgcgttccgcttgaacaaaaggctgatgccccgcaaggcagccagccatccgatgcctaggaacaggaaccacccccattctttctccaaggcctggtaggtgagtgctgccgtcagcccgatagcgagggcaaggcggaaggtgaggctgtaataaatgcctttaaagttcataccgcttgatcttattgtaaagcgtttgccgtgagatacccaactggttcgccacgagcgagagattaccgctgaatttatccatggcggccttaatcatagtatactccatttcctcgagcgtagtgatgtcattcttgacgggcgcctcccgcttacgggggaaatcgaaattgctgccatctaaagtatcaccgtcggcgatgataatcgctttctccacggtatgctccaattcgcggatattacccagccaaggttgggctttcagcttttccttggcgtcgtcggtaagggtcatggactttttaccgtagatgttggtatatttcgtgatgaatatctcggtaagcggtacgatatcctccggccgttccctcaagggcgggatctctacgtgtatcgtattgatacgatacagcaagtcctctcggaattgctctttctgtaccatctcctgcaagtcccggttcgtggcgcagatcaggcggatattgatggggatcggggtattgctacctacccgtacgatgctccggcgttgcaaggcggtcaataatttggcttgcaaatgataagataggttcccgatctcatcgaggaacaagcttccgttgttcgctacctcgaacttaccggggcgatccgtccgggcgtcggtgaaggccccttttacgtggccgaataactcgctctcgaacagcgtctccgtgatagcgcccatatccaccggtaccatggcctcatccttgcggggggatagcaggtgtatttcccgggccagcatttccttaccggttccgttctctcccgtgattaatagattggcgtctgtcttggctactttctctatcagcatccgtagttgctgcatggcgttgctgtctccccagaacataccgctttccttggataccaactgcttgttgccggcaccgcctttatgattggccgagcggatttggtaagcggcttgcaaggtttccaataatttagcgttgtcccaaggctttaccacgaaatcggtggctccttccttgattcctcgtaccgccagatcgatgtcggcgtaggcggtaaagagaacgacttgtatcgagggatatgccttcttgatctcggagagccagaacagcccctcgttgccgctgtttataccggcgctgaaattcatgtcgagcaatacgacatccacgctctcgtcgtgcagcgtgttttttatcttgttcggggtagagatggtgataaccttctcgaagcaagttcctaacagcatttgtacggcggtcaggatacctttattatcatccacaactagtatagtgccttgttttgccatgtcatgtccatttatacgggcaaagatactcgatctggtcgatacttcctaaaccagatacatcctatttctgtttcatataccgtatggataaagaaataacgaatataaatggtcagacgggagggaatatcccggatggcttgccaatccctagccgttattgggcgatcctagcgattgggcttggtgttaccgtgtcggtgttggatggggcgatcgcaaacgtggctttacctacgattgccggcgatctccatacgagtccgtctgcttctatatgggtggtgaacgcttatcagttggcgatcacgatttctttgctgtcgttatcgtcgatgggagagatctgggggtatcggaaggtgtatacgatcgggttgctgttatttagctgtacctctttggcctgcgctttatccgattccttgtttacgctgattatcgcccgtacgctacaaggttttggcgccgctgccatagcgagcgtgaatacggccttgatccgtattatttatcccaaacgttttctggggcgaggtatggggattaatgccttggtggtatccgtatcggccgccgctggtcctacgatagccgctggtatattgtccgtggggaactggccttggttgttcgctataaatatcccgataggtattaccgctttgatattgagctttaagttcttgccgcaaaatccggtgaaggctgtcggacgtaagtttgatgttacggcggcactcatgaacgcattgacattcggtttggtgatagcgattatcgaggcgttcacgcatgatgtacatatctcattgataatagcggcgattgttatcgtattgttctgtgggtatttctatatccggagagaggaacggcaggcatatccattattgccgatagacttgctgcgtattcctctttttaccctttctatcattacgtctgtgttttctttcatcgctcagatgctggctatggtctctttcccgtttttcttgcagcgggtactgggacgcgatgaggtggcgaccggcttattattgactccttggcctttggcgacaatggtgtgcgcccctttggccgggatcttgtcggagaaaatgaatgccggggtcttgagtggtatcgggttgattatcttctcgggagggttgttctcgttggcggaattaccggcgcatccttccgatctggatattatctggcgcatggcgctttgcggttgtggcttcgggttgttccagactcctaacaatagcctcatgatcggggccgctccggaaagtaggagtggaggggctagtggcatgttgggtacggcccgtttgctgggacaaacttgcggggcttcgctggtagccttgatgtttaagttatttcccggccatagcatgcccgcggcgttatggctgggaagtgtgttggccttgatcggggcggttattagtttctcccggatcaatcgtaaggcttgatcggattaggcgagatgcgattttacctgcattttcgcccggtatcccagcaggcatacagagcataagaagcctaatgggtaagccatccaaatcccggcgataccccaatggaatgtgaatcccaatagatatccggcaggtatggctatgatgaaataagcgagaaacgagatccacataatcgctttcacgtcggctagccctcgtaaggagttcgctaaaatgatttgtgcgctgtctcctatttgatagagcatcaatatggggagtagtgtcttcacgattgcgttgacatgaagattatccgtaaatattaatccaagccaggattgggtcatgaataaggtggtgcagacaatacaaacgacaataagccctagatgaagcccggcaatggtgatcttacgcaccatataccagtcgttcgcccctttataataactggtacgaatcgctacggcggctccaagacctaaatagatggtaaaactgatcgttgatatggtaatggctatttgatgggcggcaagctcaaggctacccagccaacccaccatgatggcggtgacgcagaatgttcccgcttccaagccttgttgcagactgatcggccagcctatggaattcagccttctccaactttgcttattgatacgaatatgggtgaaacctttccggtaaggcttatagtcggttcgcagcatgaatacggcgatgaaaagcaatagcatgatgatacgcgagataaaggtgcttatacctgccccgagcagtccgagttccggcattccgcattttccgtaaatgaggatatagttgccgatgatattcagcagattccctgtcaataggacccacatggatatggatgggttggctatgccttccacgaattgacggaatgaattataaagcattacgaatatgatcgagactaatgagactgcgaaataaggtcttatcaatggcaagagttcttcgggttggcctaaagagtctaggtttaggtaaatccccagtaagacggctatcaataataaggtggtagtcatattggcaaccagactgtttttgagccagcctccgatcacgatctttttattcatcgctaaattctgtccgatcagcggggtaagattataggagaatccggttcccattatgataaatgcgtttattacattattgacgaacgatgccgccgctagttcctccgtactgtgttgtcccaccatgatggtgtctgccaatccggtgatgatagcccccaattgtccaatgatgataggtacccctagcattactaaggatttataatattgtttgtaacccgctattctattgtacatatgtattgttctgttattaatgatggtgtaaaaatccttgatcgtatatgccggatatacgatagagttgttttaaatgaaaatgtaaagataaattagaaggaatagggtgcggatacggtagagcctctcgtagtccaatggacgaacaagatgcttttagtcgtaaaaaaataatattcgaatttacagctcatacctcttctttgatttagcggcgcaaaattacgtaaaatcactggaatccgcaaaccttcaaaattacctttgtttttgggatcgcactttttttatatctttacggatataagataaatgaatgattatggatcagttcgtagaacaattaaggcaggtgtctcctttatcagatgagatcgtggggcagctgttggaagaaatgaaagaggtttcttttgctaagggagaattatcgattcgggagggagaaagagatccgttcgtttggttcgtgaaaaccggattggtccgggctttcgtggagcgtgaggggaaagatatctcgttatggttcgcctcagatagcgaggtgatcaattttgtttatcggaatatctccgcctataatgttcaaatggtggagaatacgacattattgagaataccgaaaacgaaattggattacctatgccggagctcccttgagttggccaattgggggttgaaaatacaagattactatcttcgggaatatgagaactattttataaacgatagttggatggaagctcgtgaacaatatgagtcattgctgaaaacccgtccggacttgatcttgaaactacccttgaaacatatcgcctcctatttacagataaccccacagtcattgagccgtatccgtgcttccgtaaaaaaatagggaaaagtcattatttatcatagggtaatttttcttgttttcaatagccatatcttcgcgtcgttaaaaacgtgaagtggataatatgaaaatgagtggagaaaaggcgatccatcgccaagagttggagcgtggtttactaactcaaaagatttcaagactatttctgaaatatacgataccgggagtagccggcctattattcctcgggattcagtcggtgatcgatggtgtgatattagggcggtttgtcggggcgaacgctttggccagcgtgaatctgatcttaccttgctatagtttgatgacggctttgtctatcgtgataggagtagggtgtcagaccttgatcggtataaacctcggacgttcggatcggcaagaggcgaataacgctataactacttcgttcttgtttcttggaggaatatccgttttgattagcgggttgatttatatattcgccggagatatcgcccgtatgttaggtgcgaatgacgtattggttacgggagccgtggactatattcgttcccttgtcccgtttttccctttattatcattgatgttcttaggagattatatgattaaggcgatggggcatccgctttatgccatgatcgtaatgggaagtacggtgttgattaatatcggtctggatcttttgtttatcccggtaatgggtttagggattaagggggcgggattggctacaggtttggcctttaccttgggagcgctgttcaatattccccggatgttccagcgagggcaagtcgtagcggtacaaagaggacgtttccgttggcctttggtctggaatgcgttatacaatggctcttcggaaggaatatccgagctatctgccggaatcacgatttttttgttcaatataacgatgatgcgatatttaggagaggatggagtcgccgcctttacggcgattaactatatcttgtttatcgccaccacggtattcttagggatatccgatggaattataccgattatcagttataatttcggggcgggaagattggaccggatcgagaaagtgctgagattagcagggcgtgttaattttatgataggtataacgttattcgccatcttattctttttcgggcaacagatcacgtcctttttctttaagggaggagaggctttggacgctttggcgatcgctaattacggcataacgatttattgcttcaccttcttgatgagtgggctgaatatattggcctccagttatttcacggctatcggcaacgctaagctgtcggttgttatctctatgctgcgtagcttggtattcgtaacctttggtattatcgtttatccttctttattcggcatccaaagtatttggtataatgtaccggtggcggaattgtgtacgttatttatctcctttatgttggtaaggagagaacttttaaaagaggccgtgctgaaaaattaatcagcacaaccttcttaatttcttattcgatattcttccgtatcttggtcagatactctttcatcttctcggaatccttatccttgatgatttcttgcaggatatgcaattcctcttgtatccgctcgatttggcgaggggtacgggggttgaaaaggatctcggtcaatagaaaatcgtcctcggacaaaaggccgcgggcgattttcatatggcgtttgaaagtggtacccggggcatcctgatgcttcatcgtagcggcaaataccatagtggaggcgaatgggatacctagtgagtaggctaccactttatcgtgctcctcgaacgtgtattcgcagatatgcaagcggaggctggaataaatatccttgaagaatatcttgcccagatgatcgccctcggagataataatcgtattctctttctccagttgtcccagattagcgaatgtaggtccgaacatcgggtgagtggagacatacgggaaaccgcatgtctcataaaactccttcaaataagtcttcacggaagcgatatcggaaataatgcaatatggctgcaagtaaggcattacggccttgaaagcctctatcgtgtaacttaacgtcacgcagttgatgaccaactcgggattgaaatccttaacctcttccgggctttgtaggcgaagggcgttatagataaaacgcatacgtttcggatctttctccaatacggctacctcatgatcaaaactaagcaggtcggtgaagaaagaacccatctttcctgcgcctaaaatcaatattttcatcttataaattattgttcgttcatgataatcatttgctggcgcacggattcctcatggatctccttcaagatctcctttacaaagtccgggctcaggtccatttgctcacccatgcaggagcgtttctctaagatctcgctgtagcggggagactgtaagatcggcatattgtgctctttcttataaacgccgatctccttggagatacgcatacgtttagccaaaagctccaataattgctcgtcgataccatcgatctggcggcgaagagcggtcaggttctcggtagtctggtttacgtcacggatcaccaataggttcaatacgtaatccaatacatccggggtgatttgctgggaagcgtcgctccatgcgcaatccgggttacaatgagactctacgatcaagccgtcgaaactcaagtccatcgcttgctggcaaagtggggctaccaactcacgcttaccaccaatgtgactaggatcacagaaaataggcaggtccggcatacggcggcgaagctcgataggaatatgccacaacggaaggttacggtagattttcttgtcgtatgagctgaaacctctatggatagcacccaaacgatgaatgcccgctccgtacaaacgctcgaacgctccgatccataactccaagtccgggttaaccgggttcttgatcaatacaggtacatcaaccccttttaacgcatcggcgatctcttggacagcgaatggatttaccgtcgtacgtgctccgatccaaaggatatcgataccggctttcaatgcctcgaatacatgatctttagtagcgacctcggtagataccagcatgccggtctcttttttcactttcttcaaccaagccaatccctcggctccgatgccctcgaatccacccggtttcgtacgaggcttccaaatacccgcacggaatatcttaacgcctctggaggctaatccttgggctgtttctaacacttgctcttctgtctcggcgctacaagggcctgcgattacgataggacgttgtgtgtcaactcccggtaatgctaacggttcaatcttcatttccatctttgtgatctatattttaattttcaattttcagttataaattctcaattctcttcaaggcttcttctaaagtctcgttcttgcagcaaagggatatacggatataacgctcgccacggctaccgaagatgaatcccggcgtaaggaatacgtttgcctcgtatagcaccttgttggcgattgcctcgccgctctcggcggagtcggggatacgtccccaaaggaacatacctacttggttctcgtcgtactcgcatcccaaggtacgcatgatttgtccggcaaggttccggcggctacgatagacacggttcatattgtcgtaccactctttctttgcgcttagggcctctaccgccgcatattgcatcggcttgaactgtccggagtcgatattgctttttaccttcagtatccattggacgaattgggcgttggaagccagcatcgccatacgccaacccggcatattatgagccttactcatggagttcatctcgatacagatatctttggctcccggtatgcttaagatacttagcggatgctcattcaagatgaagctataggggttatcattacatataataataccgtgcttccggccgaaggccactagtttctcgtatagctctacgctagcgttcgcccctgtgggcatattcgggtaattggtccacatcagctttacattggagagatccattttctccagttcctcgaaatccgcttgccatcccagttcctctttcagctcgtaagggatcaaacgagcctctactagcttgctgacggaactatatgtcggataccccgggttcggaaccagtacgccatcccccggattcaagaatgccagcgagatatgtaagataccttctttggagccgatgagcggttggatctctgttttcgggtccaagtctacgtcgtaccacgtcttgtaccagtcggcgaatcctttacgcagctccggtatgcccacgtacggctgataaccgtgctcgttcgctttgcgggcatgttcacacaacgtctcgatggtttgttccgaaggtggaaggtcggggctgcccacgccaaggttaatgacgttcttgcctgcggcgttcatctcggctacttccttcagtttcttggagaagtagtattcctgtacgctacctacacggttagcgggtgtaatgttacacactttgttttccttctgcatattcgcctaatatttttaagtcttttgttaacggtctgatagcgtccaacgcttgtttgtaacgggtaaaatccgtgaaagtaagatcgatgtagaacaagtattcccattcacgcccgataataggcaaggactgtattttagaaagattcatgtcgtaaaaagagagaacggagaggactttggaaaggctgccggaggtgtggggaagagcgaatacgagagaggatttgtttttatcggttcctcgaagcatctcatccgccgtccagcggtccgctatagcgaggaagcgggtgaaattccgtttgttagtctcgatcccctcggcaaggacttccatcttgtagatctgggcagccagtttcccgcatatcgccgcatgtcctttcagttggttttccgagatccaccgggcactcatggcggtatcctctttctctaccaccttggcgttgggcagagtatcgaggaaatcggtacattgcatcaacgctatcggatgggagttgacctctgttacctcgtgtatcgaggttcccggaagcgctaccaaggaatgggagatacgtagtttgtactcacctgtcacgctcagtccactttcacggatcaactcatgattttgcaaaagacttcccgctatcgtgttttcgatagccatcataccgaggatcgccggatctttcttgattgtcgtgattacatctcgaaaagtattacaaggaataatctctatttcctcaccttcatgataattacgggcggcgatgtcgtgatacgaaccggctattccctgtattgctactttctttttcatcttgtttctctatttttactctaaactgttacaaacaaaaaaagtcccaccggaaccggcaggactttatattttattgatatttatattcaatcatcaacgctttacatacaaactcctgcccttactctgctaaagtaaaagtaataaaagtaatatgtaaagctaaatcgattcattgtctgtttgtttttaaatacgcagcaaaagtaacgcttttttggaaactacaagcaaaaagtgatattttttttctgttacatttaaattttatcttaactgtttctgaacttctgtggagatacgcctacgtaccgtttaaagtatttaccgaaaaaggatacattcgggaagttcaaggagtaagatatctcttggatagtcaagtccgtagccatcaattgcgattttgcgtccatgattatcatatcggctatgatatcggatacggaacgtccggtcttttgcttgatgatcatgcagagatgctggggagaaatacttagttggctggcataaaaagccgtttgccgctttgaggtataattcttcatcaccagttggatgaatttcttgtggatctcgtcgctacgggtcgttatcttgttaggccatgattttccttgatacaaatcgctgatcccatggatcatggtaagcaggatatgtttcaccatctccctgtttatggatttctccttcacttgtacccgctctagcaggtggaaataatcgttaatgaagtccgcccggtcctcgttcaatgctatgaccggattctcgtagatagtaggtaaggcgctcatcgtagactttatcatgttcacacagtccatgaactcggatgagaatcctataaaggaaaggcggaaactctctttctgctcacagaactgaataatgcttcccggcatcaaggtgatgaaatcattcggtttcaacgtgtactccgtcaagttgatggaagcccgtaaatttccttcaacgcataacacgaaaatacctgcttttaaccggcaagtctgcttgtaaaagtttaagattgcctcggtaatgtcgtttcctacgacataatcccggggcaaatctaattgtggtaagtttgcgttcatccgttattttattaatgatcgaacacaaaagtagtaaaagtgctgttgattcacttcttaatttaaaaatagaccaattaatccttgaatcagacttattccgcttgtgcttccttattccgtttatgcaagcttttcagttcgaaggatagcatgacacggaatatacctattattaataaggcgtaagcgatcatgtaaaccaacgtgaaggcccctagggcgggttgccagataacaccgatggagcaaaggatagccaagataccgaagaccatgtaccaaccccagttccgtgtaccgtatcgtttcaggtccatcgagtaaccggttgccgagaagcctctgaacataagccagaatgccaagacaaacggaagcacctccatgctaagtcccgggcttgccatcaagaatatacctaagatcaagtcgataatacctccggccaaataccatccccaactgctgataccctttttgttcgccaaggcgaaagcgatctcgaacaagccgcttacgaacatagagacgctgaataagatactaagcgctacgtagctcgccaatggcgcgaacattaaataaatagcgacgatgatgtaaagcagtccgaccaatagtgacaaccaccaattcttgaccgcataatccattttatcaataaatgttttcatattggataatatttgtattgtaattatccaattaacaaagggaaggaagaaaaagttctgggtatttgtggctaggatatccttaaaaactttgtcctttggaaattaattcttttctttgacgtttcaaatcaatataggtatataagtacgaggattatgatgaaaaatttgatagcgataacttgttttgtcgtggcgttggtgtcttgtaataaggtggaacataagctggaagggaaatggcaattgaaaaccgtagaggcgaatggggtggtccagacggtggatacggtttggtataacttccagacctctttgttcgagtaccaattatatgacccggcaaaggacgtatatcgtacgaatttcggttataagacgttggagggagatacgagactggatctggagttggtcaattatggaggtacgcctttggaacaattcatgcgttatacggattggacctcacctaaacaaactttcacgatcgagcagtcatctgtgacgaatctggtaatgagctgcgaaggaagaacgtatacgtttaagaaattctaagatatcatgtgctgtttgatctcagtccctcataaggagtactccagtactccctaagaagtactgcgatactctttgcgaagtactggagtacttcttacgaagtactctcagcgatgttagatcatgcgatcaaatccgcttctatagcttgtgccaccttgattaaatcggcgggggctatctgtatctgcaagcctcgttgtccggcgcttacatagatcttatcgaagccggatgccgtaggatggatatatgtagggaaatgctttttcatgccgataggcgagcatcctccccggatataaccggtaagcggtaacaactctttcacggggatcatctcacatttcttgttcccggataccttggccgcctttttcaagtccacctcgtccgctccggggatcacgcatacgaaataaccgctcttatcgccatgtaagatcaaggtcttgaatacttgggcgatatcttcccctagctgctccgctacatgcgtagcgctcaggtcattctcatctacttcataaggcacgagctggtaggcgatcttagccttgtccagcaggcgcgccacgtttgtcttattaatcttctctttcatcgtttagatccctttcatggataattgaacacgttttctggataggtctacgcttagaaccttcaccttgacatgctgatggatggagaccacttgggtaggatcgcttacgaaacgatccgccagctcggagatatggacaagcccgttttccttgatccctacatcgacgaaacaaccgaagttggtgatgttggtcacgataccgggcaatacttgcccttctttcaaatcctcgatcgttttcaccgtaggatcgaacgcgaatacttggatcgtttggcggggatcacggcccggtttatccagttcctccatgatatcaagcaaggtaggcatcccgaccttatccgtaaggtagtccgttagttttagtttctttttaagcgctttgtcggtgatcaggtcggctaccgagcattttaggtccttggccatccgttcgacgatcgggtagctctcggggtgtacggccgagttgtccaacgggttctttccgtcgggtatccgtaggaatccggcgctttgctcgaaagccttctctcccatacgggggactttcatcagttctttccgggatgtgaagggtccgtgctccgcccggtaattcacgatgttttgcgctagcgtggggcctaatcccgagatgtaagtcagcaaatgcttgctcgccgtattcacgtttacacctactaaattcacgcaactctccacggtttgatccagactctttttcaaggcgttttgctctacgtcatgctggtattggccgacaccgatactcttcgggtcgatcttgaccaactcggccaaagggtccatcagccggcgaccgatgctgacagctccgcgtaccgtgacgtcgtattcgggaaactcctccctagcgatcttggacgcggagtagatagaggctccgttttcgctgactacgaacacttgtaccttgcggtcgtatcgtatattcgtgatgaactgctcagtctcacgactggccgtaccattaccgatggcaatggcatctatggcgtaagtggctactaactgggcgaccttagcggcggctttgcccttctcgttctggggcggatgcgggaagatcgcctcgttatgcagtaaattcccctgcgcatccagacagaccaacttacatccggtacggtatccggggtctacgcctaatacccgtttttgtcccaagggaggagcgagcagcaattgccggaggttctcggcaaatacccggatcgcctcctcatcggctttcgccttgctctggttggagaactccgtctcgatagagggtttcagcaagcgtttgaaagaatcgtcgacggctgtagccacttgctcggaaacctctccacgaccttttacgaaacgccggttcaagcgatccagacaagattccgcgtcgggagagatacttacacgaaggataccttccgcctctccccgtcggagagccaataagcgatgggaactggcccggttcaaaggctcgctgaaatcaaagtaatcccggtatttggcgccttcctcttctttccccttgatcactttggatgtgatcatggcggtatgagcgaaagagttacgtacggtattacgtgccgattcgttctcgttgatccattcggcgataatgtcccgtgccccttgcaaggcttcttcggcgtttttcacttcccccttgataaaactcttgatgcgtgcggataggttattctcgttttgcatcataacgatcttagccaagggttccagtcctttccggcgtgcgatctccgccttggtgacccgtttcggtttgtaagggagatataaatcctcgatctcggtgctatcccaagactcctcgatgcgtttccggagctcgggagtaagtttcccttgctcttctatcgtggcgaggatcgtttcctttcgtttgctcagttccgtcagtttatccagttgatctttgatggcaccgatttgcacctcgtccagtcctccggtcacctctttccggtaacgacttataaaaggtatggtagcgccttcgttcaagagcccgattgtccgttccacttgtccttccggaatttgtagaaaacgggctataagcgtgtgaaatacgtttgtcatatctagttttcttagaattggagtacaaatatacggttttgcttatattttcggtcgggatgctcacttcttgggcttattatttgtatctttcattaattttcaagaattttacggccggaatattcaagcctttgattaaaaaaatcaacatggaagttaatactacggagaacaaaactttggaacaggattatagggatttagcaggattgttatctaatatcgtggactcgttgcccatctactttttcgtgaaggatacgggtgataatttcaggtacgtgtactccagccctttgatgaaccaactttacggacgatatcataatgatgtggtcgggaaaacagattttgacctatttctagatccggtcgtcgcccaatctttcagggatatggacgaggaggtggtgaaaacgggtaagatgcagcgtttcgtggagcaaatgatcgatccgaaaggtatcttgcgtactatggatacgatgaaactgctagcgccccgtgaggataagcctccttatttagtagggatttcatgggatattacaaagcaaaggcaggtcgaggaggagttgcatagctataataagcgcttggcgctcgcatgtcaagcgggtaagatctacccgtggctttgggatctggtaaacggtacggcggagctttccttggaagaaaacggccagatcaagcatgtgcagatcacccacgctagttttacggagaagatccatccggattaccggaaggtctatgagaatattacaaccgctttcatgcggggcgagatcgattccatgcgattcagtttcccttgtcgctatttctcggatgagtatgtatggctggagaagatcggtgaggtctatgaggccgatccggacggcaaaccgatccgctcgatcggaatccttcgggatatgaccgtcgataaacggcacgaggcggatgtgcaggccaagcgtttggcggaagagagcgaccggatgaagtccgcttttatcgctaacatgagccatgagatacgtacccctttaaatgccatcgtcggcttttctaccttattggcggagagtgacgatgaggaggaaaaaaaggaatatctgaggatcatagagagtagcaatgagtttttgttgcagttgatcggtgatatcttggatatctcgaagatcgagtccggaaagatggagtttatttatacgaccctgcgtttgagtgagatattcgctccccagcagcaagctttcgccttgagagtggccccgggtgtaaaggttatctttgagtcggacggtaatgactattgtattgtgtcggagaagacccgtttgactcaggttttgaccaatttcctttccaacgccgtgaagttcaccagctcgggttctatacggtttggttatcgtttgaccgatgatggtatctatgtctacgtaacggatacgggtatgggaatcagtaaggagtctcaagcgagcatattcaatcgtttcgtgaaattgaacagctttaagcaaggaacaggattaggtctttctatctgcaagacgattattgagaagttgaaaggtaaaatcggggttgagtcggaggagggaaagggctctacattctggtttacgataccttgccaaccgatgaaagtgaaataagacattcaagtttggttggaatttataggtaaatcacctcatccgccaacaaccgaatctcatccggattatgtgacgtgaaaagaatgatccgttcttctttcatttgcttttctcgtattcgttctataatacgatggcttaaggcttcatccaagcctttgaacggctcgtccatcaaaaggagaggagaagggtatgccaatgccctagctatagcgatacgttgttgctgtccgtaactaagctctttaggatatcggttcccgaagggctccatttccatttcctgtaagtgtttttgggcaattcgccgggctttttcctccgtgagaaaagaggagagggggaggatgatattttcttctgcggttagatggggcaggagttgcggttgttggaatatggtggcgattccaaagtgtcttgtgggatgtatctctccttccgtaggcaataagatacctccgattaggtttaataacgttgtttttcctttgcctgaaggtgcgctaattccataaataatccctttttgaaaggaatgggaaaagtgctgtatgccatattggtaacttatatctttcgtgtctaaaactgataatgtaggggtggggatggtctgatcctcattcgcgaaagatattttaggggtgatatcagcgactttgctaattcctttatcaaaaaagaaactgatgaataccgccacgattgtccaagcgagcagctcagggacagcgataaagttttgcgcccttttcatctcgcttccgattccgaatgcgcattgcgacaagacttctcccataatgatcgcacgccagccgaatccggcggcggaggcaagtccgctatataagaatggctttagctgcggatagatgatctggaataagacattggaacgtcttatatggaattgacgtgccataatggataaacccggacgtagatcgaggattccccgtgtcagattctctgttagtagcgggaacatggtgagaaaggcgatcatcaaagggatactttccggatttaggaatataagcgccaaaagtatgaaggatatgaccgggatcgagcgcatgatggcaagcagaggtctgaataattcatacacccactcaaaacgggcgaataacccggccatccctatcgcacaaacgaatgagatcgacatgcctaagactccccggaatatagtagctccgaccgactgatagaaactaccggagacgagccattcgcaaagtgtccgtacgagccggggaagtgaaggtatcagctccggttggttggctataacggcgaatagttgccatcccgccaagaggatagcggtagcgactattgtagtgattgtttttcgcaatctcattgttcttggggtataaatccggcatcgggaagcttcccgccgacggccttgggttcatactgttcgatgagacgtaggaaacccatgacggcgtctttcgccttgatagctgataaataatagattttacaccgctcgatactcttaggagttaaggccccttggtcgaagattccatgttcttccaaagaatggatggtctctttcggatatcgtacggctttttggcaggaggctcgtaaggcatcctcaaaagcggtacgatatttctccatcgtcggggtgtatacgaccgctgtttgggcgaatccgagggtatcgttgtctgtaaaatgattcaagtccgcagttattcgtaagctgctgtctttccgtaaagcgatgcttagaaacggttccccgagcacggcacgatttacttttccggctaagatgccttgggtgatttccccggcggtattgaaggcgtaattcaaaggataatctaatcgttggcggccgagatagtaccgggtaaggatatcgggagtcgtaccgttgccgaatacatacaatgccggttctttcaagggagttttctcaacgaggtaaagggttccccagatcgggcaccccgctagtttgatcttgatccctttattgtacaagttcgccgcattgatcatggggagtacggctatgtcggtctcctgcttgatcagtaaggcttgcgccagatcaggcgagtctaccacttttacttgtacttttttgttatctataattggaggattctcaagccaatcggcgaatgcgataacggatggaccacgaagtaccgaaaccttgattacggtatcttccgtttgtgcgtgccggcaaccggagcaacaaagtatgaatagtagaaaaatgtatttaatcatatctagacctctataaaacaattaaggattgcctcccggcaacccctaaccaactttgttaaccttaaatctaatactattatgaaaaaaccacagtgcaaatgtactgttttctatatatctgtcaatagaataaatgctaattagtgttttgaggttcataagaaaagctaaaaagccttcttttgagtcgctaggctaaccaaaacaatcgttatcgccgataatggcaaagcaaataagatcggatctatcgcatgccacggatatacatcgatcaagacgtcttgtccgaataaagccttgcaaagtcctaccggagccgcttccgccttatgaaggaacaacatggcgaataaactggccaagcctcctacccataagctggccaaggccccttgccgggtagcccctttccaatatagcgagcagaaataggtaggtaggaatgtagccgcgcaaatacccatgaacaaggcggtgcctcgtgcgataatactcgcacttagcgtatagcagataacgtagctgaccaagatagagcatagcacgccgatacgtacacctaatgtagagttcggatttttgctacgtcctagtttggggaatgcgtctgccccgaaagccgctcccatggtatgaaattgtgcgctaagggtagacatactggcagagagaatacaaagcatgaaaaccgccccgaaccactccggcatcgctttattgataaatagggggatgatcttgtccatatcttttaccgcctcggaggcgactacaccttccgtcttgaggaaaaacaaattagacaaggctcccacgtgataaatcgcccctaccgtgacaatcaagaatacgcagccgatcaatacgcccctgttgagttgcttggtactttccaccatcatgaagcgtacgactagttgtggctgcgctaagcaaccgattcctacgccaaggatcaatgaggtaaccaatgtataccattgtggagagcctgagatgggcatagctgtccacccttgatgtcccaaggccttgaagcgttcgggcaccatgggggcgatatccgtcaacttctggtttgcctcgataaagcccatgtccatgatatggtaaaaccaaaatagcaggaatagcatacaagcgaacatgataaccgcttgcaacgcatccgtataaagtactcccttgattccacccgtaatcacgtaggccgctacgatcaaggtgaagatcaacaaggccagatgaaggtcgatatgaaacatctgctcaatgaagacggctcctcccttcatcaccacggcggcgtagaggggcatgccgatgaaaatgatcgaggcgatgaagatctgtatagaccgggacttatagtgtaatcccaataattgcgggaaagtccgtgcgttatgtgcctcgcctaacttccgggtccttcgtccgaaaaagataaaggctaccactacgcccatgaacatgttcaataagcaaagccattgaatacccatgccgaacgtagcggctacgccaccgaaaccaacgatcgccgatgccgagataaaggtcgccccgtaagacagagccatgataatggggtttacttttcgtccgcctaataaataatcactggcgtttttcgtctgcctgtatccgagataccctaaccaagcgattacaaacatgtaaatgatgacaataatgcctaatgttagcgtactcattttcgtgattctttagtagggtttgttttttcgtcgtcttctttattccaagtggttatcccgaaccaaatagaaaataggaggcaggcgaacgctagaaggtaagccagccaaataccggggtcgctgattccgaacatatatccgtgcctattaaagttttattagatcactttcacagatatactcgagattctgacggcggattacctcacgggcgctttcccggttgttcgtacgcaagatcaagatcgctttttcccggatggagaaacaatacatatattctatgctgatgcccgctttcgtgaaataagataatgtattggcaaaacttccggcgcatgagctggttacgatcgctaatacgtcggtcaggtttgcgctgacgttgttttcttttaatatcttgtatgccttctggggatcgcttacgatgatacgaaggattccatactcggaggtgtcggctacggtggccgcgatgatgcggatgcgctcttctgccaataacgctaatatctcgcttaatttcccgtacttgttttctaggaaaatagaaatttgattgactgtcataaggtgttattttaattgtttatttaacaaagcttgcgatgatctttcactcgtaccgccttaccatctgtggttggcaaagatcccttggctaccagcttgatacgcggcgtaagtaataattcgtccttcaactgacgggtgatacctttcgtcaagcgctgtaaggctgaataatcatcggtgaataggtcgctcaactctacctcgatcaacatctcgtcgctgttgccgatcgtttcgagggtgatcaagtaattgctgcccaattccttgaattgcatcaatatcttttcgatttggatggggaacaggttcacgcccttcaagattatcatatcgtcgctacgtcctttgaaacgggcaaggcgtttatgggtacgtccgcaagggcaatcgcccggtaagatgcaagtaaggtcacgggtacgataacggagtaaaggcatcgcctcccggttgatggtcgttaataccaattctccgacttctccctcgggcaccggttgcagggtaaccgggtctacgatctctacgatcacgttgtcttcccagatatgcaagccgttctgctccgtacattcgaaggctacacccggcccgttcatctccgacataccgaaacagttgtaagccttgacacccagaagctgttcgatgcgtttacgttgttcttccgagtgaggctcggcaccgatacatacggtgtgtagtttggtatcctttctggggtctattccctcctcatacataacctcggccaaacgagtggcatagctcggtatgatatgtaaacaggtggtgccgaaatcggtgatgaacttaatctgtcgtttggtattaccggccgccgcaggcactgtcaacgcacctagtttttctgctccatactggaaaccgaggccaccggtaaacatgccgtagccggatgtattttggaatacgtccgtatcccttagccccaccatatacatgcaacgagctacttggttagcccattggtccaaatccttggcggaatgtaagacaacggtaggattacctgtcgttccactggaagagtggatacgtacacatttctgtaacgggatggctgccaatccgaacggatagttatttctaagatcatctttcgttgtaaacggaagtttttgtaaatcctccaaggactgaaaactgtccggggtaattcctttctctttgaatatcttatggtaaaaaggggagttgcccgctagttctatggtttgtttcagtcgttccagttggaattttaccagatctttacgatccatggtttctatttctttctgccaatacatcatcgttttttcaattagagtgtgtttaattcatgaaattagattgcaaatgtatcttttattttggataatgccatgcttttgtgtcaaaatattagtaatgaccttttgaaaataagaattattaggcggtaagccgttgtaaataaaaaaataatagttatttttgtccattacgcaatttaactttatgtatgggccatgggaaaatatgaccacctttccaaagaagagttgattcaaaggattgagagactggaagccgatgtggaaaaagccactttgacaccatccgcgagcgataacgaacttgagatgcgccaaagccagcatacgatcaacttcttaaatatcttgatggatacgatcttgtcgaacgtatttgtggagatcacggtgaaagatattttcaacggtttccggtatatctattttaataaggcggcggaggaatttacgggggtcaaggcggaagatatcttagggaagacggatttcgagcttttccctgattcccggcgggcgcatgagatccgaacggaagattaccatacgatcaagacgggacgtatggtaaaggaaatggtcgagtatgagaaaccgaatggagaggtgagaatcgtaaatatcgtacgtttactgatcacgaatccggacccgggagcctcgcctctgttattggtcatgctgaatgatatcacggagcaacgtcaagaccagttggcgctgatgaaagtacaagaggcggataagatgaaaaacgcttttatcgctaatatgagccatgagatccggaccccgctgaatgctatcgttggctttgcccatctcgtgacggaaacgactaatgccagtgagcaaagggaatacttctcgattataaataagaattgcgatttattgttgaaacagattaacgatatcctggatttgtcgaagatcgagtccggtcggttaaactataacgtgtcggaagttgagttgagggatatttgccaagaggcctatgtggtacaatccttgaagatgacttccgatgtggcattattatataactcggtcgccatgccttctgttcgtctgtggatcgatccgcaccgggtagaacaggtcttgttaaatctcttgtctaatgccattaagtttacttccaaaggttttatctcgcttttttatgaggtggaagatatgttcgtacgtgtctctgtcatggataccggaatcgggatatcagaggaaaagctggagtctgttttcgagcgtttcgtgaaattggatgatttttatcaaggggctggtttgggactacctatctgcaagatgattgtagagctgttgggtggtgagatcggtgtgcgatctgagcttggcaaaggttccactttctggttcaccttaccattggttgttacggataaggctgttgtggagaaggatgatccttctgttttaagtgaatgtcaactatattaaataaaaaagaaatgaaaaatgcggttgtctttttagcgacaggctttgaggaaatagaggccttgggtacgattgatgtcttgaggcgtggtggtgtacgggttatgatggtatctattacgggtgaccgattggtgataggagctcatgatattccggtaatggctgattacctgttcgaggaggcggatttcagttgtgtcgatgccttgattttgccgggtggaatacccggaagcaaccatttaaatgcgcatgcccatttgaaagaattagtcaaggagaaaacggaggaaggcgtattaatcggtgctatctgtgccggaccgatggttttaggtggtcttggattgctaaaagggaaaagggctacctgttttcctttcttcgagccaacaatggtaggcgctacccctacggataatggagtagagcaggatggaaatatcatcacaagcaaggggccgggttttatgtttgagttcggcttgacgatcttgaggaatctgaaagatgaggaaatcgctttggaagtggcggatgccttattatatgacgctttgttgcatgggacaaagcattaatgtgcttgaaattaaaatcccttgagagaatgtctctaagacattctctcaagggatttttgttgtaaagagttttccctttcctaaattatttctggaaagattttttcatgcgtgcgatatctgtcaaatagtcttgcagatcttgctcgtgttcttcttcctcagctaagatatgcttagcgatatcacaagtcgtgaagtcgatgccgtccgtgaatttagcgatttcttgataacgcaagatggcgcaacgctcggaagctacattctggttcagaaggcttactacgtcaaagtctgtcggtgaatcatatttgcatcgggctaattcaaaccattgtttcggatcaagtaccggaactccttccaattcgatgatccggtctgccaataattgggcgtgatgcctttcttcctcggcatgttcctcgaattcaccttgtacgtcggaacgcatggctccttcaacgaccaaggctcctacccaatattgatagtatgctagccattcttccgctaacgcggcgtttagttgagataataaattgtcgacatccaatttccctcttaaaattttgacgctttcttttgccatagctgtattaatttagaattaaacgtattgttcgttttttatagttctaacaagcttactagggcattgtttattgtttgtcaaaattttaacgttatgctgcgattgttacaatttaggtaattcccaaggtgcccggtaataggctttcgacaaggcggtagcttcgttatcgccgacaaacaaattgtttttatcatcccaatgaacttcccgttgaacccggcaggagatattcgccagatgagccatcttcgctacacgggcaccgatagcgacatcggcgttcggaagctcacggcttttaatgcagctcaacatgtttcccacatgattataaagtcctttgccttctcctttcttgaaaggaacggcttccatgcgggctacgttattggatacgaccggtatgacctcccaaccggccctgtcgagtaccatcgtaccattctccccatagaacgctaatccttccttacggttatagagtccgtgattgattccgcaggcgtgatcccagatgatattaaaatcatcgtaggcataagttgccattaaagtatcgggcgtctccatagcgtcgtccggataggcgaacttgccgccgcctgagaatacacgggtgggaagacctgcgttcataccttctagggcataatccagcaaatgtacgccccagtccgacatcaagcctccggcatagtcccagaagaaacggaaattataatgaaagcgataaggattgaacggacgtttaggagccgggcctagccacatatcgtaatccacaccggcgggagcgtcgcaatccggtttaaccggaagtgtcggcttgccgtcttggtaagcccagaccttgaccgtacggatccgtccgatatttccggctttcaagaaattagccgcctcgtcccaatgcgggtcgctacgttgccattggcccacctgtacgatccggttatatttacgggcggctttttccatcaggttgcattcctcgatcgtattggagagcggcttctctacatatacgtcttttcccgcttggcaagcccagaccgtcggaaggcaatgccaatggtccggcgtaccgataatgactacatctacgtctttattatcgattactcgtcgccagtccttatataagtgaggtacttttttccctgttttcttctcaacgtcggcagcccgtttgttcaaccattcgtcatcgacatcgcaaagagccacgcattccgtctctggataatcaagaaaagtattcaaatccccgtatcccatgctacggcatcctatgagggctacctttactttgttgctaggggcggtttgtccgtatatggaggaatacgatttaccgataagcggcgataaagtaagtccggacatgataagtccggttttttgcataaaagtacgtctgttcatgatattagtttttaatactgttataaatatattccatatccacgtgctcccttacgagggcggcgagtttgtcatactgctcttccttaaaagcggcataatcgaaaggacctgtagtcgtttccgtgtcaaagccttcagctaagttgtccaatacggccggattatcaaggataccatgcatataacttccccagcatcggttgttgaggtaatatccgtccgttcgtccgtcttccagtcgggctacgggctgttcgggggcgtcacccaatagggtggttcgtcccatatgtatttcgtatcctttacaatccttattctccgaggaggggaggaaagcaaagtcgctttgtctcgtgatcttctcctgctcgatgaccgtgcattgaggcagaagaccgagaccgggaatcgccgggatatttccctcgatactttccggatcttccaagcggactcccatcatttgatagccaccgcaaataccgatcacctttttacccgctttatgcgcccggataatcgccatcgctatcccattggcccgcaggctttgtaagtccgataacgtattctttgagccggggagcaggatgatgtcggctttctctatctcatcgatattgttggtataatacggattgaaacgggggtccatctccaatacatcaaaatccgtgaaattagacattcgtttcagcaggatgatagctacattgattttcccgtctttataagtgttatttttcatatccaacgctacggaatcctcttcctctatcttgatatcccgaaaccatggaattacgcctaccacgggaatcccggtcaattcctttaacaggctccgtccttcttcgaataaagaggcgtctccacggaacttattgatgataacccctttcattaacactcgttcctccggtcgtaataaagcgatcgttccatatacagagccgaatacgcccccccggtctatatctgcgatcagataggtggaggcgccggctttcatcgccatacgcatattggtgatatcccggtctcgcaggtttagttcggagatgcttccggctccttccaatacgatcgggttatagcgagcttccagacgcttgaaggcttcgatggcttccttaaatagctcctccttctggttttgtatcccgaaataatccttggcggacatattgccaactggctttccgtttaatacgacttgcgagcttttatcatttgtcggctttagtaatatcgggttcatatccgtatgcggggaaataccgcaggcctccgcttgtacgacttgcgcccggcccatctcgccgccttccggggtagagtaggaattgagggacatattttgtgccttgaacggtgccggttgataaccatcttgcttgaaaatacggcaaaacgccgcgttaataacgcttttacccgcatcagagcaggttccgacaaacataatcggtcgtaggtgttgcttcatctgtatagattttatttacacagtgtacaaaggtagtatttttggtctttttattaaggagaagatatgaaaaaagaagaagattttgttatgggcctgtccatctacatggcttgtctgcgtgagaaaaaacggtattccacggcgaagagttatcaagatgccttgaattcgttcaagtgcttttgcggtatggaggcgattccttatgcctatattaataggaacaggcttttgtgctatcagtcatggttgttggacaagggccgttcgttgaatacggtgtctacctatatgcgtcggattcgtcacatttataacttagccgtggaggcgaacgaggctccctttgtacccaacctgttcaaggatgttttcacgggcgttgagagcaagcggaagaaggcgttgccgcaagagatgctggagcgtatgtttaatgctgaattggaggatcaatccttgcggcgtgtacagttgaccgttcggttgatgtttgcgttcagcgggatagcgtttgtggatcttgcgcatttgaaatgggagaatatccgggatgggatattgcagtatcaccgacaaaagagcggatctctcatacagttggaaattccctccggggcgttgcggctgttggatgagttgtccgcttgtacggcaaaggaatccctttatttatttccttttttgagtggaacgagaaccggtgaggcggcctacaaagaatataacaggatcttgtcccgctttaaccatgacttgaagttgttggcgagatcgacaggcgttacgcttccggtcacctcatatacgatccgtcattcattcgcctcgttcttgaaggaacaagatgtatcgatagaggttatcagtgagttgttggggcataagtctattaagacaacacagatctatttgaagagcttctcgttggaacgtttatcgcaggtgaaccggaattgttttgagagcgtgtgtaaaccgatacccaaagtggggtaagaggctcgctactcgggaagtagcgtattctttcacggcgcaaaagtaataaaaaataacaaataacaagcaatcattaggtttagtttgtgctccgatcttgattctctttaaatcttcgttcttattcccagtatatagacatggcaatagagacgaaatgatctcgtatttcctacatcatcacgtccgattcttttagtcatttgcaaaggtacgcgtttcttcgatacttgcaacccttccagacgatttttttatcgcttattctctttcttatcaataggataggttatcatttacgaaacaagcgattccttcaacgaaccttccgtttcgacgctcaaaaaacgcaagatttagacgatcgtttaaactagtcgtttttaatggcaaacgacgattttcaattagtctaacaggttgattatcttaataaacactagtattaatattaatttatttattatgaacaaaaagttttctactcttttggcaggtatggcgcttgttgctgcggtatctgctaatgcgcagacttctattgatgtcaagaacgggaagattgacattaacacgactgcggaaactttgcctaagtatgacaaagataccaagggcggcctttatcaattgagagatgcgaatggtcagatcttgatgatgcaggaagtgaatggcgaatattcattggtcgcaaagaatgccaatgataacgatttcgttttgaaaaacacgttatggtgtgtaactactcagccgtatagtcaaggccaagcggtaaaatttgatttcatgaacaagggtactggcatgatgttggatatcgctatgggtgatgatctgaaaagtgcggatggtaagaagggttattggtggaagcctataatcggtggtgagatctctggttgggctttctcttctgtgttgaatagcttggagaagaatgttcctttgtattctcactttagtacagactctgttattggcttgttgaacgataacggaacaatcaaggttgctaagtatgcattgaacgatgtaaaggtagatcctgcagctgctacagacgttacagatatttcaaatccttcagctgaagcgaagaatactttctctggttttactttgtatcgagcagaggatatcgtattggatgcgaatcaattgaataagatcttcgatttgcaggatgctgatgcgggtgttaaattgaatttctctccggatgttaagggtaccagcttaaagaatccgttcaatgagaaggaatttatcgcaaaatctacaggtgataaagactattacgatgtggatgctagcagtaacgcgactttggcaaatggcgaatggctttatgtaacacgcaagaacgatgatggtaaggacacttatttaaaggtcgatacggcgtatacgaatgagaccggcgctaagttcttggcttatggctggactggacctgataaaaataaaacagccgctcaacgtttgggtagcatggacaaccaacataagttcttgttcgtttattccccaagtaaagatgaattgaagatttatgtgaaacaaatcacttggagaccagaggacaattctattaaatactggaaggatatttatgaaggtgctgattaccatggaaataactggcgtgtatctttgcaagatttgatcaaggatgagactcgtatcttgaccgttgactctgagaaacagaatacaaccatcaagttaggttatggcggttgcgaggctgaccaatcaaagacctctgttaaggatggtgtttattacatcatgaacaagaagggtgagtacttagcttctccgatctatgagaatggcgtgattcgttggactactgtgaatgctgatgagcaaaatgtagctcatatgccagcctatcaatgggttgttttgaagacaaacgctaaagatcagaataatctgtcttcagtaacggctactaaccgtgagtttgatgatgcgaaaggtacatttagcctgtataagaatgccgatacggaatatatatatacaaagagtgatgtagatttaacgcaaggtggtggaactcatgagaaatttacagtaaatgcaaagagtgacttacgttttgtagaggttccggctgaggctgtatctgattctttgttaggttataagaacttaacgaacgatgagttgaaggttaataaatatacatttaattactggcatccgtatgcgacggataaatacatcgctaagtcttctaaagactcaactttgacagttaatgttggtgtatctgcctttaatgtagatactgctaagagaagtgcaaacagctctgtatatgcggtagagaagtttggttttaaggttgagaaagaacatcaagatcgtatcaaaggcttgaaacaactttatagaacggcttatgtagtgaaattaaatggtattggcttagctatcaataaagaggataagttcaatgtacctactcataacgattatcggactacaggcgaaaatgaggaggttactccgttcttcttcaaggagaataatgagatcaaagaaacgggtaagtgttattatgcgatcttgtctactgaaaaagacactaaagatgtaaacgatgtacattattcaatttcagatgacaacaaggctggtgtatctgactatgatggctctgctacattgaaatctcaagtattgaaagaatccagaacatccgcattcgctatcgaaccggatgagactccactgtaccgtcgtttcaactctcttgagcttgaaggcaacgaaggtgacaaggctgatacattacgtttcatcgagaaatatcgtaaagagtacttgcaagttgagaacaacaagaatttcatgaatggtgatatcgatttcttaggtatctacactccggataagacggaagatggcttgtcattcatcgttgatacggcatgggtaaatcgtggcgctggtaatatcaaacctcagtatttgatctcaatcgatcgtaacgacttcgagggtacaccgggtgttgcttgtacatatactcataatcactatgacaatgaaggtaacaaggtagacgcagcgcactgttcacatgctactccggctatccccggtttcgagagaggtaagtatttgatcaacttccatgatttcgctttgaaacatgataaggctaatacttccgatgcgaagaaagacgccgcttatatgtggaagaaatatgatcgtgccggtttcgtagaggctgttcgtgtagctgatacattgttcatcttgagagacgaattcaagaacttgaagaatgaggagatcacgattgaggctttaaataaggctgaggaagcagcttgggctgccgctaagaaggctggtgtaagcaaggataacttcgtatcttacaaatatgttttatctggtgacaaccacaagtatgtgacttggtcaatgcgtttcgttaacagaaatgctgccgctaatgaggttgaggctgatagatcattcttgtttgaatcaatgcaggcagacggtcttgacatcgctcctacaaaagctgcttggttgaaaatgcagaatggttgcttggtattgtctgataaagatgattctaagtttgacgaaactgctaccggtggtgacgacgctttgatcttcaacgtagagcaaggtgacgatatcgctacagacaacgagacaatcgaagctgtggaaggtgtttccatcacaactgataacggtactgtaactatccaaggcgccgttggtaagtcagtagttatctctaacatcttaggtaaggtagtcgctgagacagttcttacatctgataacgcaacaattgccgtacctgccggtatcgtagctgtagctgttgatggtgaggaagctgttaaagtggttgttaaataattaaacaaatagataggtcaagagatgggggaatcccccatctcttcctttaagaagatatttataattctgaaattcccgtgtggagatagattcttcaagtacaccgcgatggtagaacatgcgggggtattaatactaaagtaataaattaaaagctcaggtcacgagaacttctgtgaagaaatgtcgtgacctttttttgtactcttaaatctcttgctatgattatatctactcaagaaacattgatctataaatcaattagtccggaagacatttattgttatactcccggaatcaccgtgacttcgacgggacgcttggtcgtgactttcgacttgggcggcaagggggtaaaagaaatctatgcttcttcgcagttgtacacggaaaggacaagacggttaggtatcggtaagatttttgtatcggacgaccaaggcgctagttggtgttttatctcggattttaatttttggcatgcccgccctttttgtataggggaaaagatatatatcataggaaacgcgggcgatttatgtattatatgctcggaagatgatgggaatacgtggagcgttccctcgtttctctcccaaggtgagaaatggcattcttctgcctgtaatgttcttttcgctaacgagcgggtttacttggcgatggaacagcgtttttataactcggagatagaaggctggaatgtggcgggtttgagccctaccttgctatcttgctctattcacgatgatttactggatgcgtcttcttggcgacgttccgatccttttgttttcagggataaggtacatttcccggaaggggttggcattcctttttacgagtcattgaccaataagccgctggaattggctcccggtcgttttaatgcgcccactggatggctggaggctcaagtggttcaaataaaggataaacatcatatttggtatgatccggaggggaaaacgttccatatgtttcttcgtgcgcataccggagggattggatacgcttgtttattaaaagtgagggaagataagaacggccagatggtaaccggctttcaagagactccttccggacagaccttgcttttcttgccctttcccggtggccatttgaaattctttatagtgtatgatgaaatatcccgattgtattggatggcatccaatcaatctttcgattctatgcggacgataagctcattacctgagacttcccggtatggactcccgaataatgagaggcatcgtttacaattattattctcgaagaattgtgtggactggtgtatggctgggatgatcgcttgccaagggaatgaattatattcaagaaattatccttcgttatgtatcgtaggtgaggatatgcacgtggtttgccgtgcggcggatgatcatacaaaggaccctcaatactctgattgtattacatattataaaattaaacggtttagaatgttaatctattaaatgaagtgattatggaaaaagtactgattgtaataccggctcggtatgattcaagccggttgccgggtaagcctttggttaagattaaaggtatagagatgataaaacgggtctcggatatagcggattttgtatgtcgcaaaaatgagtcttgttcttatttggtagctacggatgatgagcgcatcgtctcgttttgcgaatcccgggagattccggtgatgatgacttccacgaattgtaaaagtggtacggaacgttgctatgaggcggtaaggaaacaggacaccaatcccggactgataataaatctgcaaggcgataatcccacgtgtcctccttggatcttgcaagatctgatcgatacatggagaaaggagaaggcggaggtccttaccgcctcggtcttgttgggatggagcgaatacgatcaattactggcgatgaaaaaggaaaccccttattccggcacgacggtattggtggatcggctgggatatgccttagctttctcgaaacaaaccatacccgctatccgtaaggaagatcaggctagggatcttttgcctaaaagccctgtcaggcggcatgtgggtttatatgcgtatagcggtcgagccctcgactcttatttctcattacctccgtctgtgtatgaacgctcttatatagaaggattggaacagatgcgcttcttagagaatggcatcaaaatgagggtcgtagacgttgattatcggggacgtgagacaacaagcggggttgattccccggaagatgtcaaacgggttgaggaaatacttgagaagtatggagagttcgatctttcgtgacttagatggaatcgtagattctattttatctccctaccatactttggaggaggttctaccttctggctgtgatgctggtccggtatggatggattttgactgttgggtagacagccaaaaggtggatatgcggacatcggaatcacccttactcttgaatatatgtggtatacccgcatccggtaaatcgtattgggcggaggaatggctatcagagaatggaccttgtttgcatatcgctttcgacgctattatggaggcattatccgggtatcaagcggattgctcgctagatagggagaaagcgttcttacgttgggaacttcctgctcgttttttaggttaccgtcttcttttgttgggattgaggaatgggtggcctattttatttgaacatagtaatgcgttgagagaacatgtggatttgtataagaagataaagagtcttggatatcggattcatatggtgtgcatcgatgcgacaccagaaatggttatcaaaagattggctcggaggaatcgttttttcccggaggagcaagtaaaaaaacgttgggattgcttgatagatttgttacctgaatatcaaaaaatagtagatgactttaaattaatacaaccatggaaaaatgtagaaaacttgtgatcgtacggcatggtaatacgtttcgtgcgggagagactccgactcgggttggagctagaactgatttgcctctggtagaggaggaacgagctagatctgcgggacgttatttacgtgaaaaggggattgtgatcgacaaggtgatttcggcccccttaaaacgcacattggagaccgctaattatatcttggaggaaatgaatgtggatttgcctatcattcaagacttacgtcttaaagagattgattatgggccggatgagaatatggtagaagatcatgtaataaaacgtttgggatctctctatttagaaaaggagggaatggaccggaaagacctaacggaagatcggatcgtggagaggggactttccgtgatcgcccaatggaatgagaaggccgtggtaccgttaggatggaacgtagatgtagagaaactgataagcggttggcaggatttggcggctagtatccctgatggtgagacttggttactagtctcttccaatggagtgatgcgtttctccccctatattctggggaattatgaggatttctgtgcgactcatgatattaaggttccgacaggtggggtttgtatattcgattgtgtgggtgatcattggaggtgtacggattggggaataaaggcttataaactttttaaatgataaatcatggaagatatatggaatataacagctttggtagttagtgtattaagtgtgcttttgtctctttatgctttaagacaggctaccactaaaaatacctcggatatgtatctgttctttatctcgcaatatgcgaaggaggacatgaaattggctttacgtaaattgaaagatataaagcggggggtatatcggttggaacaatgggagagtgatatgaaaaataatttgccgaaagcctttgagtatgacgaggcgagacgtttggtgaaatatttttatgatactttagcctatatgaagttggagaaactaatagaggctcgttttgtaagattgatttgcttgaagaaaggggcatggctttatctggacacagtcgaagccatggaaaaattttttgacagtggctatgataaaaagccatatgcggttattcgggatgtatgcgaaaatttacgaaaggaagggtgttgtcctccttagttcattattttcggcttttggtgatttaataaagccttgatcgaagaaacgatcggggcttttatatttatttcttaatttgccatgacaatattccgcaagtcgaaaccgaattgaatatactcatcctcagttatttgcctctctgttgtcaggatgattaacgcatgccctcgataggtgtttctgtaagggggatggaaatggttgtaatggttttcgaagaagccgcattttttatagaactttaatcgcttggaggaagtttcatccgtaataggatcgatctctaataagataatcttattcaggcgtttattaaaatcctccagcaataaaccgccgtatccttgtcccctaaagttctcatgaatggcgaaatgttcgatatatacataggtgctaaaatcccagtatgagataaagccgataaagaggttgtctttcagataagccactagatgatagttgggagattggaaggcctgttcttgttgttcttctgttcgctgctcaaatagagggaaacttgccgtatatatttgctcaaaggtaggatagagaggatcttgctttcgcgttatttctagtatgtccatatgacttcgctttattttgatgcgaagataataatctaaaaacattgtcatgtcatattaaagctttatttttggatgatcttataattaagatattgtatacgatgatagcgtggtttcgttatatatgtttaattgttagccttataatcaccctgccggaattactttcggcacaacgtctggtttctcaacgtcaagaggatgtagaggccggtcttttatataacgagagcgtctacatcctatctaattattcttgtctatcctccaattccccggaaaaactttctttggacgagttattgcggaagcagatcgaaggcttttatttctatttgaagcgggatacggagacaaatgtattgttactaaggaaacctgatggtacgtttactccttttagtgaatcattggaagccattaagacggccttggatgcggactccactaaggttatgacgcttttcctcgatttctatgtagagatggagctggaatcctcttttaaggaaataggcttgatggagtatgtacttgagtatgatacgaaaaacggatggccatccctgaaggatatgttgagttccggaaagcgactggtcgttttcgaggttcagaaacatttgaacagtccttcatggttgcataatatgagggattttgtggagcatacggacgctgattggggaaatcaaccggaaggggttgagagttttgatgagcggctgaaaaagaatttgtctttatttaccggatataagttcttagagacttcccggggaaatagtaatgatatctcggctttagcccggcagacaccctatttaatagaatcgtttaaaagagcgtggatccgggatggaagggttcccaattttgtgttagtagataagtattacgcatggttggatgtctcgttggttactttccggaatttcgatatcatttacggcgcggttacgaataacaatgagttgcttaactacgtgaattgggatgggatgtctaattatacgacgggtaaatattgctttccgctagagcccggagccgagttgatgctttccccgatttctccgggctataggatagagccggctacggtttatatctccggtacccaaaggaaggctttcgctagcgattttaaggctagacctttgcggattgacgaggatatagagatttatttaccgtttgagggcgatgagaaagatggttcgtccaatcataatctcacggtatctaggaatgtcgagtttattcaggaccctatacgggggcaggtcgcttccttggagaatcaggcccgtgtggatttaccgaccgcttcggaacttcatatgcgggaccatgatttcactgtcggcgtttggttgaaaatacctaagtacctgccggagaaggaggattattgtattctgggagctaagaacagtacttatcaacaagcgttgcatctgttgatacggaaccggaaaccgtatatgggattctttaacaacgatctggttggtaacacggagatcgagccgggtaaatggtataatgtcgtatggcggtataataagcggaatggggagcaggctatattcgtaaatggaaaactggacgcgatctcttttgatcgtccggcttatctgggtagtgatagcttatatgtcggcttcgtgaatttcagccagtcctcgaacttcgtgggtgtgctggataatctttgtatttggtctcgtgtgttgagcgataaggagatattgggattgagcaaccagttattagatttacatatatcgaatgcgattacttggttggatgtccttggaattgggttgattttgatggttctggtctcgatagcttatctaggctatcggaaggtgaaagaaaagccaaggcaggatgaggctgatgcgggaacggttgcggaggagggaatcgaggaaggaaccgaggagccggatcgttcttcgcgagagatgccggaggagatcgaggaggttccggttctgcgcaattatatccgattgtttggagagttctatgtgttggaccgggatggaaatgatataacctctctatttacccccaaattaaaacagctgtttatcttgattatgcttcactcttcccgtggaggtttcggaatatcgagcaaggacttgacacggatgatttgggggaatgacaacccctcgaaaagtacgaagagccttcgaagcgtatctatattgaaactccggaagatattggaacgtatcgatacggtcgaggtcctatttaacgcgaatcgatatattctccagctttcggaagatgtctattgcgattatttggcttgtttggattggctgaaagataaacgggtacggactcagccggactttgaatatttctatgatattatcagcaaaggagaagtgttcaaaggggaatcgtttgattggatggatgattttaaaagttatatctgtaatagtacggtggatgtcttgtctcgctttatcgacacttactcgatcgaggatgaggcggatcgggtgatccagatagcagaccagatccttctgaacgatccttgcaacgaggaggctttgctctataagatcaaagccttgatttaccagaacaacttcaaattggcccgttatgtgtacgaccgcttttgcgctttataccaagagatgtatggcgaagctttcccctcttcttttgagcaggtcgtaccgtctccgctgatgagtcagcaatctccccagtaagtattatagtgtgcctgctcattggcaggactgtgccatcgctattgtcacacctgtgccatcgctattgtcacacctgtgccatcgttgtggcaagaccgtgccaccgttatggcatgcctgtgccatccgtgtggcactcctctggcattacagtgacaaatgtatgcgccccactgatagcgatcctttcgaatagggaggcaggtgctatgcctctgacttatcgaagatttttataaatatttcttgatttatttatattgctgttattatgtgaattatgctttgtgctgatatgaaattagccttaaattagccctaggttaatgtcttgtttagcgttcgttaactcatggtttactgctcatccctatattcgctctcgttgtttcgcacgaggaagcgaagttgtgttttactatatatattttttttcgactttaaatttaatactatgagtaacactatgtctgacaagaattcggtgaacttcacacgtagggagttcttaggtacagtagctgctgcggcgtttacaatcgtacctcgttccgttttgggtggaccgggctatacggcacctagcgatatggtcaatttggccggtatcggtgtgggtagccaaggtggtggcgatatacagaatatcgctactccggatgtacctattaaaaggagaccttttggtggaggcggtatgctgatgcaaccttatgcgggcatccagccacccagacaggaacgaagagcgtcggataatcctgtgcaaatgggagatgcggagaaacaatcgtttaagcatgcgaatatttatgcgctatgtgatgtagaccacgattactccggacatatcttagcgggatacccgaaagcgaagaagtataccgatttccgggaaatgatcgacaaggagaaagagatcgatgcggtattgatcggtactccggaccacacccatgcggttattgccgcttatgcgatgaaagccggtaagcatgtatttgtagagaagccgatggctaagacgatttatgagacccgttttttgagggatctggcaaagcaaaccggtgttgttacccagatgggtaaccaagggcataatattgaagggactatgcagacggtcgaatggattcaaggtggtgtgatcggtgacgtaagggaagttcatttgtggacaaaccgtccgatgtggcgccaaggttattttgatcgtccggcgggagtggatataccgtctaatcttaactatgacgtgtggttgggaccggctcctgataaaccttataatccggagatgcttcatttcgcttggcgtggattatgggattacggtacaggcgctatgggggatatgggagcccataccttcgacgctccgatttgggcgcttaatttgggtatgcccacgaaaatacaagctacttccaccccttacaataaggactatctgccacaatcggaatgcgtgacatatgagttcccggctcgtgggaatatgcctccggtaaaggtaacttggagtgatgggggtataaaaccggctcgtccggcggagttggaaccgaaccgccagttaagggaagcgctttatataggcgataaaggtctgatcatgcatggtacccatggagcggagccgcaactgataccggaaagaccggggttcgtagctccggcgaagacattaaagcgaccgagtaatatttatgtggattttatcgaggcgataaaggaaggtcgcaaagccgctaatgattttgaggtatccgctaaattgacggagattatgttgctgacgaatgtcgctgtcgccgcgcaacggttggatcttacgttggaatatgacgcagagaatatgagaatcacgaattgtccggaagcgaacgattatttccactatgagtatcgtaaaggctggagcctgtaagggactttcttctaagggttaagattaatttataaattgaatggttatgaataaagatgtgaacaatggtcagtccagacgtgagtttctaggaagatcggtcgctgctttggcggccgcatctttccttccgagtgctttctcttgtacggggaagagtgtggcggctcccgctccggttgatacggcggcggaggcaggcaaggttaactcgaagttcggtggcgtgcaaatcggcacgatcacttatagttggcgttccatgccgggtggattggagaatatcatcaagtattgccaagaggcgaatatcagttccattgagttgatgggaggtgacctggaagcttatttaggagctccggagaatccgatgatgaaattcttccgtcagcaagctcctcaacccgcggcgaaaccgggtgagaaacctgcggctcctcgtcggatgggtcccccgaagtttactccggagcagcaggctgagatcgataaatataaggaagcggtgaaagcgtggcgtctcgggttggatatatcaaaggtagaaggtgcccgtaagttattgagcgacgcaggaatatcggcgcatatcgtgaagatggaaccttcccgtatgggttcggacgaggaaatcgattatgcgttcaaggtagccaaggccatgggcgctaaagccgtgacggacgagattaatttggagacggcgaaaagagtcgctccatttgccgagaagcatgggatgtatatggctttccataatcatatgcaatatgccgaagaagggtttagttgcgatccgatcttagcggtctctccttctattatgttgaattttgacgcgggccacttctttggctctacaggtatccacccgaatgagatgatcaagaaatatcatgatcggatctatagtatccacttgaaagacaagacggggcctacgacaggggaccagccgaatacgaatcaagtatggggacaaggggagatgccgttggaagacgtgctcttgttgatcaaacaagagaaatggcctatctattgcgatatagaactggaatatgatatcaagccttggtctgactccgtgaaagaggtaggcacttgcgtgaaatatgctcgacaaatattgatgtagattatagaaagttgtctttggtatgtcattaataggtataacgaaagggccggttcctgatggagccgaccctttatttttcatttattgatctcttttaccaaattgggcgcgcacttaaaatggacaatggttctggggatcaacattaaagtctctccgcttttcgggtttctagccaacctgcttgtctgcaagcggggagtataaacaccgaaaccctgtatacataccttttctccggctctcgttttctctaagatgatgttattcagttcttccaatatgtaccggatttcttctttgtcattaccgactcttttcgataattcctcgattagctgacttttattcatatcgtattattttttgagaagtttgttctttgctctgttgttaaatattttttcctgtattgcaaaggcgataaacccgtgtgcctccgaaagaagcgtcccaacgaggattggttcgagaactgcgtcttctcaacaatctcttggatattcaaggtagagttggtgagtaatccttttaattctaggatcatatattccgtaatccaatctttggcggatttgccgcttacctccttaacaaccatggtcaagtatttaggggtgatgcatagagagttcgcgtagaacgtcacgcttctgttcactttgtaattactcatgaccaattgaaagaatttgtgggtcagttctttcttgtgtacatctatcgttgccgtactgtctaaagaattgactttataatggttatatatatcaaggaataatatgcgaagtaagagtataaccgactctcttcgatactggttttccggatcgacagcttttcttataagtaattcaaagaagtctacaaaggaaagagtttccacgtcttccatcttgaaatagtaatgttgcctcatatagaaaaagaaatgtggcgagaaacgactgataccgcttaatatatcagtataaaaggattccgtgatcgtgaaatatctgatttggaaatctacgctaacgtccgttaatgcgaccaattgccccggcaagatgatgatgagctctttaggggttataatgtgcttgttggaatagatatcaattttagcgtttccttttacacaatagatgacaatccctaatcttatataagaagggtaagtggtaatagggagttctttggaaagtgtaaagatcttgaagtccttctccaaagaataatcaataccactattcggctcaactatttttttaatatttcccgacattctttttgtctatgtttcttatgtaaaattataacttcgtcttttactatatttatctagtggttgtttggtataatattacagaaatataggtctcgttttggcgttttttaaagtttggtttaaatgataccttgaaaaataaccgctattggatgtttttgtttgtaggtctaatacttttttgcaaatacggttgaggtgatgttagggataacttgtattctaagggctgtgcgagctggatggaatatgtgttaggaaatattagtaattcaggttaaggacaagcgtgcgagacaagaacgggaaggattgcctcgcacggcaggcttaggtcgtcttttagataaacttgagtatatcttctgccttttccgctatatgatcgggtgcgtatttctctaattccgtacgagggcgaaacccccatgttaccccacaggaggtcacttcgctgttgatggcggtttgcatgtctacgtccgagtcaccaacataaagagcgttctctttggatatgctcgctcgttctacgatctcattgacgatactgggatctggcttcgcctttactccttcacgctgtccgagaacctccgtaaattgtatggaagggaagaaatgggcgatgagcttacgggtagcggcttgatatttattagaagcgaccgccagttttatccctctttcctgcaacaaggctaataactcagggataccggggtagggaacgctgcgatctgtgttatgcagatcgtaatgcttcaagaactcttcccttacctttagtatattctcttccgtcttttcaccttcgggtaacgcacgttcgaataatttgttgatgccgtttcctacgaagaagttatactcctttacgtcatgtgtcggaaagccgttttgccgcaacgcatggttcgtgctatgggctaaatccgcgatcgtatttaataatgttccgtcaagatcgaatattactaactttttcattttagttttctggcaaaattaatggaatgtagagatatactttccctttcgactgataaaatagatgaaccgatttaaaaatagataaaagtattaggtcatatataagatatttgtatctttaggacaggaatagaaatcctttgtaatatattgtataacctaaaattggaacatcatgggaaagaatcaattaattcacgggaatgaatttcatttgctgaaacaagctgagattcataaagctacaggtaaattagtcgagtcactaaacttggcagccggttctacgggaggttttgatatttataaagttgtagaggcttattttacggatttagagaaaagaaaggagatcaatgatttgttgggtatttccgagccatgtgagacacgtgtcacggaagaatgcttttcttaaataagccgcagtaggaataacatagaaaaaggagatacctgaatcagatatctccttttattatatctcaaagaaggatcaattacttaccagaaagtttttctttcaaagcagccaattcctcgatgtcacctaatgtagtcttttcaaccggaccggttaccattccagattcctcttcttttttaccaccacgttttgaggatgccttcttttcagaagttgccttagcgcctttttgctcatcttcaaagatgcggctgtgagaaaggatgatacgtttagcttccttgttgaactcgattaccttgaatgaaagtttctcatctacttgagcttgagaaccatcttcttttacaagatgcttcggagtagcgaaaccttctacgccgtaaggcaaagagataacggcacccttatccaatacttcgatgattgtaccttcgtggatagaaccaaccgtgaagattgtctcgaatacatcccaaggattctcttccaattgcttgtggcctaagcttaagcgacggttttccttatcgatttccaatacttgaacctcgatctctgctccgatctgagtgaattcagacggatgtttgatcttcttcgtccaagacaagtcagagatgtggatcaagccgtcaacaccttcctcgatttctacgaatacaccgaagtttgtgaagttacgaaccttagccgcatgacgagaacctaccgggaagcgctcctcgatgttttcccaaggatcagccttcaattgcttgataccaagagacatcttacgctcgtcacgatccaaagtcaagattacggcctcgatctcgtcaccaaccttcatgaagtcttgagcggaacgcaagtgctgtgtccaagacatctctgaaacgtggatcaaaccttctacgcccggagcgatctcgatgaatgcgccatagtcagccataacgacaactttacccttaaccttgtcaccaaccttcaagttcgtatccaaagcatcccatgggtgcggagtcaattgcttcaagccaagagcgatacgtttcttctcgtcgtcgaagtccaagataacaacattgatcttctggtcaagctgaacgatttcttccggatgagaaacacgtccccaagaaaggtctgtgatgtggatcaaaccgtctacgccacccaagtcgatgaatacaccgtaagaagtgatgtttttgacagttccttccaatacctgtcctttctccaatttggagatgatatctttcttctgttgttccaactcagcctcgataagagccttgtgagatacaacaacattcttgaattcttgattgatcttaacaatcttgaattccatagtcttacctacaaatacatcgtagtcgcggatcggcttcacatcgatctgagaacccggcaagaacgcttcgataccgaatacgtcaacaatcataccgcccttcgtacgacatttgatgtaacctttgataatttcgtctttttcaagagcctcgttaacacgatcccaagaacgtgtagcgcgtgctttcttgtgtgaaaggatcaattgtccttttttgtcttcttggctctcgatgtaaacctctacctcgtcaccaatctttaaatccgggttataacggaactcggacataggaacaacaccgtcagatttgaaaccgatgtttacaacaacctcacgtttgttcatagaagtaacggtacccataaccacttctttgtcttttaccgtgttcagggtctcgtcatacgtttttacaagatcgtccttgcttacttcggtgtaagtctcgccttgctcgaaagcgtcccagttgaaatcttcaaccggctggatgttttttaaattttccattctttaattgttaatactaagtttgttttaattagtaagttagactttatgttgtcatctctcaaaaatcggggcaaaggtaatgctttttttctgattgacaagagttttgaggggtaaaaacattcatttgggccgtgttggctgtaattacggaaaactgttgatttttattgatatttattttgtaagtttgcgaattgtaagcgataaatcaatgagtagaggatttttaagaaagtccagcgtcaatacttttataggaatagtgtggattttgtttgcggtgggcacaagtgcgcagaatgccgtgagtaaatttcgtgcggatagcatacgccaatctttatcacgtatccaaaaacctcaggataagataccccttcttaaagaattaatcggcttgtactggcaattgccggaggaggtgccagcgttgaaagagataatcgatatcgcgatgcctttggattccatcgggatcgtatacgatgcgatggctggcttgagtcgttattattataatgtagaaaatagggatagcctattatattgggtggggcaattggattcgttggcctcaaaaaggcatgagagtcccagagggttgtttttatccggtagcttggtttgtcaggattatctatggtccggcaattatgagctggctatggacaaggccatgcaatatctggatttggcccgggaaagtaagaacgattacggcctgctacgggcttatcgcgatctagggatggtgtaccagcggattaagaaagacagtgacgcggtagagatcttcgggaaaggcctgcacttattgaaaggggagaaggcgaatcctgctttccggattatgtatttgtctaatatgttggaatctaccctgctattaggacgtttgtccgagtcggaggcgctcttgaaacagtatgatcatttattggattccttggaaaggaagtataatggggagggaaagatttttccggtaaaacgtcatcgttgcttgatgagttgctattattgcgagctgtataccatgaaagggaattcgggaaaggcacaggcgtatttggatcaggcgaccgcttatttggatagttcttttggggatagggtggaggctcaatatctgcggacaaaatcattttattattggaaggagaaagattataggcatgcgttgtccgctgtcaatctggctttaaagatcaatcgtgatctggataagttggagatgaagaaagcgatattgcaatcatccggccaattgcaagaggcggtcactatctatgaggagatcatcaataagacggagacgatcaacacggatgccttcgaccggcaaatcgagcaactccgtgtattgaatgacttgaatgacctggaaaagcaagatcgggagttgaagctgaaatcggagcaagaagctttgaagcagaagcagattgtcgtatctatcggtcttctattggtcttgatgggcctactctatatgttgtggcgtatttatatgcatactaagaggttgagaaatgagttgcttcaggagaaagactccttgatcgcttcggagaagcaactgcgggtcgtgacgaaagaggcggaggcggcgaacaagaagaaaagcgcctttatcgccaatatcagccatgaggtgcgtacgccgttgaacgccattgtcgggttctcggaattattggcgagtagcgagtatagcgaggaggagaagatccggtttgccggggaggtgaaccatagttccgagctgctattgaatctggtgaacgatgtcctggatttatcccgtttggaatccggcaagatcaagttcagcgtgaagccaaacgatctggtcgcctgttgccagagggcgttggattcgattcgccatcgggtgaagcccggggtccgattgacgtttactccctcgcttgaatcttataccttgaatacggatgccttgcgtttgcagcagttgttgacaaatttgttgtcgaatgccgctaaattcacttccgagggagagattaatctctcatttgccgtggatgagagcaaaggtgaggttcgtttcttcgttacggatacgggctgtggaatccctgaggataagtgtaagaagatattcgagcgttttgagaaattagacgactttgttcaaggtaccggtttgggactttctgtttgccagatcatctcggaacagcttaaaggttctttatccgtagatgtctcttataagggcggtgcccggtttgtctttatacattcaacgaatttaattgaaacccctatatgagactgatgaatctattcaataacaggatatctatacgtataggggtggttattatgatctcccttgtattttgcggctcgatgaaatcttccacgcctcctcccggcaaggatcgtttaacagagatcgacagcttggagagggtattaccgggctgcccgacgatagcgtctactttacctatattgcagcggttggctttgctttatcggcaagatcccaaaatgaaagattattatcaacgtctttatgagaacgcgatggcggtggattccatatctatcgcatataggggattgaaaggtatggccgagtattattacaatcagtctaagcgtgatagtttggtctattgttgtaatatcgtagattctatggcgaaggcccgccatgaatatccgtatgtcttgtttgaggtgaagagttattccagtcaagatctcctttggctagggaattatgagttggcaatgagtgaggcgatgaatctgtatcggttggcgagcaatctgaatcataaatacggctcgcttcgctgttcggagactttggggctgatttaccaacgtatccgtagggatagcgatgccgtagtctcttttcaggaaggtttggatttattgaaggatataaaagatgttcccgatatcatggatactaaaatccggttaacttcttatcaattggaaagtagtgtccgaacgaaacaatatacgttgacggaacgaatcttggaacaatataaagccctgctggatgagcaatatgagattaatcaagaaaaaggtgatgttttgctactagagcgggagtattggctgctttattctttttacacgagcttttatctttcgaaaggagatttggcaaatgccaagaaagcgttggataaagcctcttcctatgtcggcaatagtttggtagaggaggactatgcaatcaatacttatctagcggttaaggctcgttattataaggcggctggagatatcccgttggcactgcgttatataaatgaagtgttggagacagagcgattacccgaagatattcagttcaaggcggatatcttaaaggagcagggccgactcgaggaggttatggctctatatgatgaactttatagaacgctgacgaaaaggcggggaacttcttttctccggcaggtgaatcaattgcgaaccttgcatgagttgcatgaaaaggaattgaaagaaacggaactgaaggaagccgggttacgtatcgcccggaaacaagatttgttggtgtttatcttatctatatcggtcgtgttatcgatcctcctctatatctcgtttttatactaccgccatctacgatccttgaaaaaccaattacagcgagagaaagacttgcttttggaatcccaaagacgattgatgagggagaaagcccgtgcggaagaggccagcctgatgaaaagcgcttttctcgctaatatgagccatgagatccggaccccgttaaatgcgatcgtaggtttctccagtttgctggtggaaccttctaccgatgcgaaagagcgggaggaatattcgtctatcatccggaataatacggatttgatgttgaatctggtaaacgacgtattggatttatcccggatggagactggagaccttcatttcaatatcaaggattatccgcttttggagtgttgccaaatggcattggagagtgtacgctaccggatgccggatggggttaaattgactttttctcccgctggggaaccaatcgtggtacatgtagataatctgcgcctgcaacaactgttgacaaacctgttgacaaacgccgctaaatttacggagaaaggtgagattaacctatcgttccaacttgcgccggatcgggaaaaggtatacatagccgttacggatacgggtgccggtattccccttgaaaaacaagctgcggtattcaatcgctttgagaagctggatgattacaaacccggtgcgggtttaggactttctatctgtcttttgatcgccgagcggctgaatggttccttgtccatagattcctcgtatacggacggagctcgcttcgtgcttatcctttcttgtgaaatagattcctcaatttataatccgccaatagaagtatgagcgtgatggcccctatgtataaatagaaagccaaggccgatgtgcttattgtggggacggctatcttgggtatctccatatatacgaaagatacgatcgcaagggaaatcatgataagcgaggccacgatcgccgctaacaggctgaaccgttcgtcacgtttcttcgcctttgcggactcaagcatgatttgtcgcattacgttcgaacggaacgaggcgggaagctcctcctccggtatgcgtttgaataaatcccccaataaatcgggttgttccttatttgtgtttatcttactcatgatccatttcatttaataatacaaacaatttttttcggatgcgatgtagcttgactttaatattcgaggcggtcaagccggtgatagagaccagttcttctattgttttttctttccaataaaagagcaagatcaaggcccgttcgtccggtagaagttgttcaagggcgacttccaatctttgaacctgttccgtggattcggtttgtccgaacaggttcgtaacctcctcctccgatacgttttcaagtgtagtctcctcaatcggtagaaactcatatctcttcttcctgaccgacgagatcgccgtgttgtaagcgatccggtaaatccatgtggagaaactacaatcccctttgaatgaggcgaggtttttgaataccttcataaacgtatcttgcgccaactcctcagcctcctcttggcttcgtaccactttgaggatcaacgagtgaatcggacggctatacttgtccaaaaggcaagcgaaacatgccacgtcccccgcttgtatcctttgtatgtaatatgtatcggtatacaattccattgtacttaatggacgcaagccgggtaaataggttacaacttgcggtaacaaaaataaaaaatatttttcagcccggaggtgtaacctatgggaaactgttgcgtcaaattagcaaacaatatgaatgaatcaattaaaattatacagttatgatggattttatttctgttccgctagttgtcggaatcgtttgtgcaggtatttacggattatttgagttgtttgttcgcaagagggaacgtttggcgattatcgagaagatcggtgataaactggatgcctctgctttcgatggtaaattgggactgcctaactacatgcgaaacttctcgttcagtagcttaaaggccgggtgccttttggcgggaatcggattaggtttgttggtaggctttattattaatatgtgtatggcgacaaattcttattatgatgatggttggtacaggcatgaggtagcgggtacggcttatggggcttcggttcttttgttcgggggaatcggcttgataatagcgttcgtcattgagctgaaactaggtaagaacaataagtcataggcttgccggtatagacgtagcgtgctgcatgcagcacgctacgtctatactacaggtagatctccccgaagaattcaggacaatggaaattaggctcgggaaggtcgatcggactccaacttacgaaatgcggattcattgtctcatcggcgcatttatagaagttccctagtattttctccggcagattactaggatctaaccccatcaacttgagtggtatgactacgatcaagttccatgtatgaatacctttaatctcctcgaatgcccttcttctcacggatgggagtcttatgatgcttttatactcttcttgcgaaagcgacgtcttgatatcccgtgaggtacggcgggcggcatcgcaagtcccgatacaattaaactcgaaattcatataatgcgagtcaccttcctttttcatgaagaactccacgcaactatccttatggaccgaggaattgtccatctcataagacgcctttagcgaattaccctgcacgctatatcgtatatatagatttttctctgtccgagctatattaaaagcggtgatcggcttatatggatactcatgccaattggcatgggtgaggaactcacgttgggattgcacctcaagaatcggttctatggatgttatatcgagtacatccagaacggggataacaggaactttcagtcttttcattttaactatagatttgaagtaaaggccattgtaagtaggaggtcaataaaaccgatagggcaccgataatagacaatacgataatgacagagcccacgatccggttcagtaaccaaatgcctctaacgttgaaccattttctcagttttccaataatatatgttatgccgaaccaccaaagaacggcccctaaccctatgcaaacaatgcccaataccagcagccaaaacgaatgttcaggcagcacgaaaccaaaccgggcgaataatccgatatagagcaagacgattaacacgttgctaaaggtaagtagaaaagctgtaataaagtcttgggtgaacgataattttttttctcggtgtttctttaggttcctagtcgggttgctttggaagatataatacccgaaaatgccgagaacgatacttccgatcaattgcaggggcgcttggttcgcctccacgaagttgaccacaactcccatgcccagacaagtcagtgccgcataaatcacgtcggatagagcggcccctaatccggtgacgaacccgtgccaacgtcctttatttagtgttctttgtatacagagcataccgatggggcccatgggggccgaaaccaatacacctataatgattcctttactaacgattcctagcattaagttgagtctcttctagttttttgggcaaagatacatccattccgcgataaaaaaaaggtaaaaaacgtaagatactgtagggacgaggctcgctcgtcccttatttcgggaaattgggactgtacaatagggtcgtatcgagagtcatcaatttaccgtctttcacgaatgagtctcctcgctcggacagatgctctaccatcatcttgcgtaattcggacaacttattctgataggctgcgtcctcactaaggttatgtgtctctcccgggtcttcccgtaaatcgaacaactgctcgcttccgttgtggaaattccagatatacttaatcttcccatcggtaagggctgcccagtaattatcgtcgctatagcaagtggcatgctccatgtctatataggggcgccattgttcctgctggccttggatcagcttaagtaaagaccgcccgtccatatcgggaggaaccgacccgccggcgatatcgataaaggtaggcaagaagtctctcagttctacaggttgttctatgctgcttccgtccggtatggatttggatataccggcgggccattttacgatataaggaatatgggccgaaccctcgtacggataggttttccgccaatgataatgatcgcccaacatatcgccatgatccgccgtgaaacaaatcagggcattgtcgtacatacctttgtcttttagggtctggatgatttgccctacttgatcgtcgataaaggtgatattggcgtaataatggcgacgggagtttatggcatacgcatccccgaaattaccgaatggggcatctgatgctccttggcgaggatctttcggctcggcgtattgtccgcaccaatctcctatatggggttttgggatatccgcgtccttatacatatccagataacgttgaggcggatcataaggactatgcgggcgggcgaatgataccttgaggaataagggcttgtcgttgtcgtagttccggatcaactcgcaagcggtctgtccggtccaagccgtaggatgaagccgttcgtctaacttatagacaccggcggcatggtcgttccagccgatacccgtaagatccgggtctttgccgggtgcctgcaattgaaaccattcccggtaatcgctgatgaaatcgggactttccacccggccactctcgtcgatcaaggtcgcgtggaatccgtgaagtgctttctgcggaaaccaatgcatcttaccgatcccgaaggtataataccccagattccgcatcatctgaggcatctcgtaacgatacttcaaggccatgcgtccgtatcccagcataccatgatgccaaggagacatcccggtcaataaaccggcccgtcccggagtactacttggagcggaggaatatccgctcacgaacaacgagccttcttgcgccagccggtcgatattcggtgagatcaccgccttgtttcccatgcagccgagggtgtcgccccgttgttgatcggtcatgatcaggatgatatgcggcttaccgctctttacgggcatggcgggagagacgacggtctctgcctctttcccgcttttgctatgcgtcatccccggaagtgtcgcacccagaccgattccgagggatgatttaatgaagtttcttctttccattatttagccttgattgtgtgatcccgaactccttttaagattccctgcaattggaaaacgatctccggatgttgcaaggccttgtttccttcctcgtagaccttcgtcatgtcgtataactgaggctcgggggaatatccggtctcaatcttctcatattccatgatagcggaacctacgctcggctcgatatatttccaatctttcgtacggacggaaagtgccttattaagcgcttgctcaattacccacgggcggtcttccttgcttttcccgatccaagtatccagataatcatagctatccggcgcgcttccttccggaagacgggaattcgtcagtgaggcaagggaggcgaaccagtcgatctggctcactagcgcatctgatacggcggcttgcttgatctcctttggccaatgtacgatagccgggatacgggttcccccttcgaaggcactgtatttattacctctaagcggtccggcgggtttatgatcgcctagtagctccacggcccggtccgcgtaaccatcgtctacgacaggtccgttgtcgcttgacaagatgatcaaggtgttttccgtcaatcccatctcatccaatgttttcatcaattggcctatgctccagtcgaattgctcgatagcgtcgcccctcacgcccatcgggttctttccccggaaacggtcgtgcgggaagcggggtacatgcacgtcgttcgtggcgaaatacatgaagaaaggcttctctttattctccttgataaaatcgatggcgtgtgtcacgatagaatcggcgatattctcgtctttccaaagcgccttgccgccacctttcatgtaaccgatacggctgattccgtttacgatggattggtcgtgcccgaaactaggcttctggttgtataataattccggattatcttttccggtcggctctccgggaaagttctgctggtaactgacatagatcggggcgtccggatcgtagttcgccacctgcccgttctcgatgaatacgcaggggacgcggtctgccgtcgccgccatgatataggaataatcaaatcccagatcgccaagggcggtggggagtggggcgttccagtcttgctctcccgctttgtctcctaggccaagatgccatttgccgatagcggccgtggcgtatcccgcgttcttgaacatatcggctatcgtataacgttccggtcgtatgatcattccggcgtttcccgcggcgatgtccgttcccgggcggcgccatgcgtactctccggttagcatggaatatcgggagggcgtactggtagaggcggtcgcgtgagcgttggtgaagcggataccgttcttggcgagccggttgatattcggggttttcacttgcgtgccgtcgtagcattccaagtctccatatcccaagtcatccgcatagatgaacaatatgtttggcgttctaggtgtaatgtcttgtctctgttgggcttttgcgataccggctgtaagaagcgaggcaccgatccctacgataagtgttgatttcatgttgtttattatttagatgttcttgttgtgtatctgcgatttcttattcatggcatgttctatggacattaattgaattatatacaaaaataaccaaattatttcagaataagggtaaccacaccaaaatatctatgagatggagcttaggaagaaatgctttttggctctggttaaaaggggggcttatcgtatattttcatgtacgctcttgctccttatcgtataatgctgtaaaaagtcgtacgtgtttcccgaaaaacatgtacgactttttacagaaacacgtacgtgtttttcaaaaatcacaatcgtgtttttaaggtgttgatattaagcaatttatatatttgtgccatttgtataccttattgtatattattattaccaagacggaacacgcactgcctatacaagagtgggtaatgaaagtgtagaatgtaattctcaacaacttctttcattgatattgaagggtatgcacatgacatgggattcacttcctacccaagtggatgccagcaaacattcttgtaaatgaagaaaagttcggagagaaggttcggagagccccataaaagttcggagagtgagttcggagacactgcggataagcctaaaaatataggtagaacagcacagaagatcatcgaccttgtcatttccgacctttctatgtcagccgaagctatggcttataaaattaggtataagttcccgtgctgtagaaaaacaaatcgcaaaattgcgttctatgggtatattgtctcgtgaaggcgcagactttggtggttattggcgtattattttaagttaccattttgaggggatgagacgcagcacgctgcgtctctacaactggagacaaaattgggcgaaaaaagtaagttaacttcgttggcaaagtaagttaacttactttgccaacgaagttagcttgctttggaagtgaggtattggagtttgaaaatcaaataaaatattatacatttgcatgactggataagtcaaagcgaataattggtatcaaacaatgataaactaaaaaacatatggattatcttaggttgaaatattattaatacgtatatttgcgacaagaaaaggctttttaattaagagcctcgtgttgcgtgtgatatttgtgctgtaggacgaaaatcggctaattttcttaaatctccctatgcacgaagaaggtcccgcaaccctttactggatatacgtgttatctatgctaatatagtatggatatattttgtatacagataaagggggcgtgtggctgactttattgggagttgggtcttagccgaaccttcgtctacataaatgttcagtcctcgcccttcctttattttataagaaaggaccactacttaacaaaagccatatagcgctcgtctttacgaaggacatcttttctaaaacatgtccggatcttgtaaatctaataattaattatgtaaagtgaatggcttatggacgcttgtgatattgatgagatccagaatctctttatttactactccgcttgtttcagcaagtattttccagagttagggttttattgtaatgagagggaattccagatacatggtatcgtgcggagatatagtgacgtcacgggagtgtcccatgatggctcttatttcttaattgagatgcaaaaagaatacctgatctacttaccgttattggttggttccaaattccgcattttaactaaacaaaaacaactttattcgtaatacgatcttatgccagaactcatatccatagaagaagccgcccgtattaccggtttcccgtacgaggagattgaagattgggtaaaatcccgaaagataacctctttccatacgagaaccggtacacgtatggtagatactgagaacctacgtgatttcattgcccatatcgaacatctagggattcaaaaactatacttgcaactggtcattcaagacaaggaggaggaagccgacgagattatcgcccagtacgacgattaccttttctgcctacgatccttaaaaaacatctctcccctacttaaacaaatcatcgccgaactatccacatttatagatgataagcaagatcggtatatattcacggaaataacctctggggcaaaaatactggacgtagccaaacggatctccctaccggtcacaagcctaaccctgtctccctacatccgtaaatgcctccaaaaattggagctggaaactatggaggacctattgcgctacgctaggaagaaagggctcgattctttgttgaagattccgggattcggccctctcggtttagaccaattaaaatttcagctggaaaagcataagatcatgaataaggccggagactcggatctctatcaatacatcatcaatgagccggatagctgaacacaaaaagagcctctcttcacagggaggccctttttatgtgatgccggaaataaccaataaaaacttcccgacactacggtgttaatcatcttatatgcttacataaaattagcagaaggctttggtttgcgatatactaatagtgttacattctttttgacattgcaaagatacgtcggcctataagggtgcgcaatacctatatatatgtaaaaaaggagagttcgtacctattaattgctatattcttcttcatggccagtgaaatatggcgtaaaaaaggcgtgaaaccaagtggaatcacgcctaaatctatctatgcctttatttttaatgggcaagcttcaactgattctccaaagcctgttttatatacccgttaatcgtagttcccgcctcttgcgccaatgctgcgattcggctatgtatttctggtgaaatacggatatttaacgtgccgctataaggtttacgaggttccacgccatcagccaaacagccggcaagatagctttctactccggcttcaaaatccgcacgaagttcatcgatagtattaccttcataaagaattaaatctttactcataccaagtacctttccgcaaagacagttatcagccttactgtactcaacagaacctttataacctttgtattccaaatagtccatattgaatcatttcatttaattaaaccattactttttaaatgctgatatatcgctttcatcatccactccttcataatactacccggatgcggtttgtgaatatcaatatattgtcccgtctgttcatttttaaatctcacgcgagaacctgacgttgcacctttattatgctcgttatagccataagaagaaagcaattttaaagtttcctcgtaggtgaaatctttaggtagtttacaaaaacgctcgatcaacttttctttagaacccatatccttgttctttctgcaaatgtaactaatattagttgcaaaacaaaagaatatggaggaaaacttcccgacactacagtgttaatcatttaatgatcttctcgcttgtaataactaacgcttacctctgaaataatacaaaaccgtattttccaaaattaactatcaagttgtcttgcgggtcaataatggggcctatcgggtgtgacgtcctgaaaatattcttcagggatacctatgagtaggtaattagggtctcattttacctacttcgggcgattgtagcaaattctcagcccctgtaattttgccaaaaattataaaacgcaatgagaacgttaacaaatttattagcgattggattactttcctttaccgctctacatgctcaagagagtaatatgagctctaccgtaaaggcatcggagatgtatgccgacggtttttctaaattccgttttggaggatatggtgagatggctgccagttatatggattatgactggaattgggtgacacctcaaggtacatcacatatgaatcgggctactgtctctatccctcgttttattttagcttttgattataagttctctcccaaatgggtactgagttccgagattgagtttgagtatggaggaacaggcgccgcacgggaagtggagtggtacgaggagaatggagaatatgagaccgagatcgagaaaggtggcgaggtcgccttggagcagttccatatctcttatctgatgaacaagcatttaaacttccgttttggacatatgatcgtaccggtaggcttgaccaacgcacatcatgaacccttgaacttttttggtgtatatcgtccggaaggagagactaccatattaccttctacttggcatgagacgggtgtggctctatttggtgatttaggaaatttcgattacgagttacaagtcgtttccggtctggacccacaaggtttccgtatggagaactgggttggcaaaggtacgcaaggcgctttcgaggaaactcaatttacgcatcctgcctttgtggctcgtgtcaactataatggagtgaagaaatttaaaggcttacgtgtgggcgcttctttttattataaccaaccctctaagaatagtagcaaaccgctgcgtaaccaaggtgagaaatatccgcttaccatcgtgacggcggacgctcaatataaaagtccgaacaataatttgatcgccagaggtaatatcgtttacggccatctgggcaacagcaacgctctgacgaaggtaaacaataactcatcttcagcttccggatatcctaattcaaccgtggcggagaccgctgtcagttatgcggctgaggttggctataatgtaggttccttctttagtcggaaagcccctagaatttatcctttcgttcgctacgaatattataatccgatgcaatccgtagaaaaaggcagtaataaactggcggatagacgtcttcaaaagagcgtgattacggctggccttaactattacgcgttgcctaatctggtcgtaaaggcggattatgcgcaccgtattgtaggtaagggtgattataatagccagaatatggtttctgtcggtatcgcttatatcggctggttcttatcaagataatagactattaacaaatatatatgtaagaatatgaaaaaagtacttttattacccatgatgttgatgggtgtggctttgagcttcacttcttgtggagacaacgatgatccgggcaaggaccccgatgttgtaacttatgactttaagaatcttcctgcggattcgggtgcaaaaccaacagaagatcagatgagtgcggttgtcgctactttcgttgatgaggtagctttgcctacctataaggacatgttgacaaagatgaccgcctataaaaatgcggtagacaagttcatcgcgtctggttctaagaatgatttagcggatgcctgcgacgcttggcgtgcggttcgtgtaccttgggaacaaagtgaggcattcttgttcggtgtggcggatttggcacagctcgacccgagcttggatagctggcctttggataagaacggtatagaggagattatagctacaggagaattcagcaagatttcaggagctgtagacgaagatgcggaagatggtcctcaaaatttacgtggattccatacggcggaaaagatgttattcttagacggcgagcctcgtgatctggaaacaagcccgttcgcaaagaatgaattggagtatttgaagttagtgtccgaacgtatgttatctgatactcaagacttatacaatggttggttgaaaggcttaggaacttcggatgttccttcttcttatgcggaggctatgaagaaacatgacggttctgcctattccattggtaatgtgtatcaggcgattgagcttatgctgaatggaaataatggtatggctggaatctccaatgaagtaggttccgctaagataactgacccggtgaccgcatggaatggaagtaataaagacgctactgacccgaataaccccggtgtcttggctgtagagtcttggtatagctggaattccttggacgactataagaacaatatcgtaagtatcaagaacgcttatttcggcggtcgtgatttggatgaggaatccgcttccgagagtagcttgcatgcgttgactaagatgattaatcctacgttggatagtttgatggtagttcaaattgataagacaatcgacgctatcaatgcgatcggctatcctttccgtaacaatctaggggatacggagcatatcaatacagctacagaagcttgcgctgatttaacgacaggtttgggcgttgttaagtctaagttcacgaactaatcggacaagccgatacgatgaaacgaagattacttctattattcgctttatccggtagtctgctgtgtagttgcgaatccgaggacttggaaaattggcaagttaagaaacccaatgggcaggtagcttccgagaaggaattgtccgcgggtatctcaaccattttctccaatgccccggatgcgtacgatacgcaggcaaactgggttacgggcgaattagagacgcgatttaatcgtggtgatggattgtacgacgatgctcgcggtgttgagaatgtggatggtggaggactagggccgctttatgccggatattcttgcggttcctgtcataaaagtaccgggcggacccgtccggctatagccgatggaggttccggccccggcttctcatccatgcttatttatatatcacgtaaaagtggcggctattttcaagattacggccgggtactacatgatcaagcgatatacggaacgaaaccggagggaagggttaagattactactacttcccaaaaatatacgttccccgatggggaggaatatgagttggtcacccctcattatgagataaaggaatggtatgctgatagtattccgatgtcggatttacggatttccgtacgtcaacctttacggcatgtcggaatggggcagatgatggcgctcgacttggatatgctaaagcaaatcgccgctaaaagcaattatccggaatatggtattagtggacgtataaactatgtgacggaaaagggaaagaaacagattggtatctctggtaataaggcgaatcatgccgacttaacggtggaattgggattctcttccgatctcggtgttacgaacgatcgtttcccgcatgaggtaggagaaggacagggtaatatgatgggttttgccatgaccggggcgcaggtctctacggaagatatggaagatgtggatttatacctccagaccttgggggtacccgcccgtcggaatgtggatgatcctacggttcttcaaggagagcaacttttctatcaagcgaaatgtcatttatgccatgtgacttccttgaagacacgccctcgcggatctgtccttttgaataatacggaattgcctcaattaggtaatcaggtgatccatccttattcggactttttattgcatgatatgggtgttgagctaggggatgattatcccagtggcttggccaacggtaatgaatggaggactaccccgttatggggattgggattacaagaggtcgtaaacggccatacctattatttacatgatggtcgtgcccggaacctgacggaggctattatgtggcatggtggggaaggggctgcgtcgcgtaccctattctctcgcatgacaaaagacgagcgggccgctttgattaaattcctacaaagtttatgaataaataacgcatagaatcgaaatgaaaaaaatatataggacgttgcttgtggtgcttctatcagcgggtgctttctccgtgaaagctcaagatacaaagaaagagatggatgataaatatgtagagaacgatgtggtttcactagcgggaaagaagggcttttccttttctaccaaggccggtgactttttgtttaagccctatgcgttggtacaggcaagcgcttgctacaaccggtatgacgaccaagggctggaaagccattatgccaagagcgtagcgaactctggtttcgcgatccctaacgctattctcggttttacgggtaaggcttttggacgggttactttcaatttatcgctgaatgctgctaagagtggaggggccttattgcaacaggcttggttcgacgtagcgatcaaggagtcgtttcgtatccgtgtcggtaagttcaagacaccgtttatgcatggctatttaagtactttgggggagacgttgtttccggtactgccttattccgcttcccaatccgtattgcttccttacgacgtgaattatgtcataccgaatatgtccacgggattcgacttgggtgtacaggttcatggtttgatcaatgataaatggaattatcaagtcggtatttttaatggtacgggtatcgacgtgaatttggcgactaagacaaactgcgatgatcataaatggttgccttcgctgttatatgcgggtcgtctggcctttatgccgaagggggagatgccaacgtctcaaggctcgccggagaatctgaacgacgataagatgtctatcgccgtatctgcctcttataatgcggaggctgagttcttgaccagtagcgacacccgtgtgggcgttgagttcgcatggatcaagaaccgctggtatgtagcagccgaaggttattatatgaatatgcattttaccaagatcatgcaaaagccggataagaatttctggggagcttacgctcaattgggctatttcatcactccgaaattacagggcgctttgcgatatgatttctatgatcgaaacgctacggatgagggtggtttgttgaatatgcccgccgctggtttgaattattatttctttaataataatttgaaactacaggttatgtatcaatatttaggtcgtagcggtcatgctacgcagaatgaccgggatgaggacgctattggattggctcgtcactccgctacggctatgttgcagttcacgttctaatctttgggtatgaaacgatatagtctatatataatgtatgccgtattcctgttattcgggctgggttgtgatgagggtaagatttatccggatgagacggttgattccgggcgaaccgctaccgtgtcactttctttcactggcctgaaagcttggccgaaggagaatatgctctcgttatgcgcttttggcgaggataagtcgaaacctttgcaaacccagcgtatcagtaagccggcggaagacggcaaaagactaaaactccgattgaataatgtcactccggatacgaggagtatagaggtcgctgtgatcagtaggggattgcggttggtttactcctattatacgtctccggtggatgattcggacgaaccgcttgatttgtctgtgggcgaattggatttagcgagcttcaaacgtgtacaagcgcaggtgttcgacttgaattgcctgtcttgtcatggcgggggatcgggattggccggtcagctggatcttagggacgatgtagcctataaatccttagtgaatgtcaaggcgcccctttcggaagagggtaagaactacgtgaccccgggtgatataaacgatagtttcttgctggatatattggaggataatccggtacataaggatatgttcaatagttctgggaaacaggaggtccttgctttgatccaaggttggatcttaggaggggcattggataattgataagaaagaaaatgatgaattatacgagaaaaatagatacggataaagcggtagaggttcagatctcttcattcacgggcaaaggtggaacaacggaatatcaggtgatggtatcgattacagacccttgtttgtctttcgtggagcaattacaaaaccttttgcgggtttatgtgactgtcgtgaaggaagagctatcgaatgacgctaccgccgttttccgccgttattttttaagtgacgcggctaatcagacggataacgtgatggagtgggagtgcgagagcgccttttgtccgctctctatcgtgcagcaaccgcctttgaatggaacaaagatcgctatgtggacttatttgcaaacgggcatgtcggtacaaacgcacgattccggtttgctggaagcgtcgcataacggttataggcacctctgggggggaggtgccttcaataaggcggccaattcggaataccagacccggcttttattgaatgactatgtgatgcaattgatggggcagcgttgtgcgttggcctctcattgtgtccgtacttggttctttgtgcaaaacgtagacgtgaattacgccggtgtggtgaaagcccggaaagaagtttttatcacgcagaatcttacggagaagacgcattatatcgctagtacgggtatcgagggacgtcatgccgatccctcggtgttggtacagatggacagttatgcggtggatgggttggagccgggacagattcagttcctttacgctcccacgcacttgaatcctacttatgaatatggagtaaccttcgagcggggtacggctgttacgtatggggatcgtaaacaggtcttcatctcgggtacggcgagtatagataaccggggagagattgtctatccgggcgatatcgtaaaacaaaccgagcggatgatggaaaatatcagcgtgttgctgaaagaggcggacgctactactcgtgatattacgcaggcgatcacctatttgagagatatggctgattatgcggtggttaagaagtattttgaggcgcattacccggatttgccacatttgatagtcttggcccccgtttgccgtcccggatggttgatagagactgagtgtatagcggtcgtgccgacggagtcgtcctttaagcctttgtgaaataataataaatgtacgagatatggaagaaaaaggagtatatttggctattcaaacaccaagacaagttagaaagaagcctatgtataaaaatggaatgtaccgggaaaccgataaaatgagtgatctgatctgcgagaactatccgatggttttagtcatgagccgctttggtatagcgctcgggttcggagagaagaatatcggggaggtttgccggcagaatggggtggatgcttgtactttcctgacggtcgtgaatttcttggtcgaggaagtgaatacgcctgtcgagaatatcagcaaatgcctgtcgatcgagaacttgatccgctatttgcataatgcccatgattacttcttgaacttccgcttgccacatatccgtcgtaaattggtagacgctatatccgggtgcccggaggatgtcgcttttgtgatcacgaagtttttcgatgagtatgcggaggaggtaaataaacatatgtcttatgaggaacgtgctgttttcccttatgtccgtaatttgttggaaggaaagagagatccgaaatacaatattacgatcttccgtaagcgtcatgatcagatcgagatgaagatcacggagttgaaaaatatcctgatcaaatactatccgggagcgggtacgaatatgctgaatagtgtcttgttcgatatttttgccacggaggaagacttggcttcacatacccgtgtggaggattatttgtttgtaccggccatattggctttggaaaaacaattataagcatgaatcgatgagtacaaatctaaagattgcgatagccgaaccttctgttatcataaggagcggactggagaacctgttgaaacggttaccgggtttccgtatccagatggtggagattcattcggtggaatctcttttcgactcgcttcgtatgcacaaaccggatgtgttgatcgtgaacccggctttgcccggctatttcacgttgcagcatttgaaggaggaaagcggctgtgccgagatgaaatgtatcgctttattatattctgtctcagacagtgtgttattgcgttcttatgatgaacaaattaacatatacgatagcgctgatgagatcaagcacaaattggaacggttgaacgccgaggtacttccggatgacgagccggaaggggatgacgagcaacaatcgttaagctcgagggaaaaagagatcgtagtctgcgtcgtgaagggaatgacaaaccgggagatagcggatcgtttgtttctttctacgcatacggtcatcacccaccgtcgtaatatcgctcggaaacttcaaattcatagtgccagcggtcttacgatctatgcgattgtcaataagctggtcgaattaggcgacatcaagcagtaatcgtatatttataagtaagttaaagggaatgtggataagcgataaaagcgccttccgcattccctttactattaatataattaaatttaatgatcatatcttattaacgcttatcgaaaactaaaacccgtttattcctgtttcttcttcaaatcattaagcttataagaaatgaagaaagcatttttacttggattagcattgttattttccttatctatgagcgcacaacatttcgcgttgaagaacaatcttctctacgacgcgactacgactccgaacttaggattcgaggtgggcttaagcaaaaaggttacattggatgtctcggcgggatataatcctttcaagttcaatgacggtaagaaactgaagcactggcttgtcatgccggaagtgcgttattggacttgcgagaaattcaacggtacgtttattggcgtgcatgcgttgggcggacagtataatatcgctgggattaaattaccctttggcatattccctaatttgaaggaccatcgttatgatggttatttgtacggtggcggacttacgttgggacatcaatggatactgaataagcgttggagtatagaagccgctatcggcgccggttatgcccgtgtacattatgataagtataattgcggggaatgtggcaccaagatcgagaccaagaactcgaactattggggtgtaacgaaagcggccctttctatcatttattttatccactaaaaaacgatctagagagatatgagacatttattgagtatatgtatcgctttattgttcctcggaggtgtgagcctacaggcacagaacggtgtgcgaggaactgttagtttcgagaatgtaagcgcaaagaaggacggaagccagcttatgatgaattttacgaccaatctgagcaatctgcgtttgaaatcccaagagatggtcatcctgacaccggtattgcaatcggtggataaatcgcagtcttaccagtttaacccgatcgtgattaccgggcgggcacgtatgaaggcgttgaaccgtgagttgggtttcaatagttatgaatttccccaaactcctagcttgattatccgtcagacgaagaaggggccggaattgattccggtggaattgtccgtaccctatgcgggatggatgcgaaacgctaccttgatggtggatgagaataccacgggatgcgcttcttgtgaggtctcaaatgacatctatggggtgatgagccgtgtattgcctccgttagctcctcccgtttatgagcttagctatgttactcctccggtagagcctgtgaaacaacggagcgagacgcattccgcttatttaaactttgaggtaggcaagtccgtattgttacgtgatttcaaggataacgctaccgtgctgaatgaggtgaataagattgtaacggaagtccgtaacgataagaatctaagctttaccgaatttaaggttaccggatacgcttccccggaaggtggctacgattataatatgagattgtccgagagtcgtgccaaggcttttgtcgcttacatgaaagataaggagaagatagatccttccttgatgaaagtgaattggatgggtgaggattggatcggattgcgtcaagaggttacgaaatcggatttggcgaataagaaggagattctggagatcttggatattcaagatataaacaagcgcaaggctaaactacatgccttgaacggaggtcggacttataagatattattggataaatactatcctcctttaagacgtattgattataccttggcttatatcgcacgtccgttcgacgtgaacgaggccaagcaagtgatcaagacgaaacctcaatatttaagtttgaatgagatgttcttggtagccaattcttatgataaaggtagcgatcagttcaaggaggtattcgatatcgccgttcgtctttatccgaccgacccgatcgctcaattaaatacggcggcccttgagattgagactggtgcttacgatccggccatcaatcgtttgcaaggtattaatttgccggaagcatggaataacctaggtgtcgcttatgcgatgaagaaggattatacgaccgctatgcaatatttcgatcaagctgcccaagccggcgtgcaagatgccgccgcgaaccgggatgagctggccgcttggttggccgagcaataatggagatacttaccttcgaatataaaaaaaagcccccgtttccggaggctttttttgtgcttataatttcgctttccattcattcatcaactcggtaatggtttcccgtaccgaagtgatcttattcgctcgccaagcgttactgccggcgaaagcgtatccattctcgaaattccctttgaaggcgttgtataaggcggtgacgatacaatacgggctgcgtgatatatcgcacgtcttgatacagttgaagggacaagctttcggttgcttgattcccgccttcactttctcaaggaaactgcaatggatggctcgtccgggcatgccgacggggcttttgatgatctctatatccttctcctcggcctgtatataggtctgtttgaaggcttccgaggcatcgcattccgtggtggtaacgaaccgggttcctaactgaacgcctgatgctccaaggtctatcatgcgtttgatatcttcacccgtataaatgcctcctgctgcgattaccgggatctttttgtcgtatttctgctcgaaatgagagacttcctctacgacttgaggtaataattcttccaatgagaaatgctggtcttccaactggttttccttatatcccagatgtccacccgctttcgggccttctagtaccaccgcatccggaagataatcatagttattcttccatttctcgcagatgatacgtacggcacgtgcgctggaaacgatgggaaccagcttggtgacgctatctttcttgaggaaagaaggcaagtccaaaggcagtccggcaccgctgaaaatgatgtctaccttttccgctatactggtcttcaccagttcagcgaagtcggaaagagctaccattacgtttacgccgatgatacctttcgctttttcccgggccttgcggatctcttccgctaacccaagattcccagcttctgtataattgctgggtgacaatttcttatataaaagtccgagaccggctgcggagataacgccgatcccaccttcatttgcgacggccgaggctaagccggaaagagagatgcctacgcccattccaccttggatgattggaatacgagcctttaggtctccgattgttaatgtcttcattaaaaaaataaatatagtgtttcaataatcgaggcaaaggtagcacaatatcccaataaatgtgcgaaatggaccagaattatcgcgcaaatattctagtcatgtgcaatgtatggaacgaaccgattattttatgtaaattcgtccctgaataattaggcaagacgtctgtaacaggattgtaatgtatgtgaaacgggtgtgaaacaggagcgttgtaactttgcgacgcaaatatagtttttatagttaggaatgaaattaggaaaagttatagcgctcatgttagtgctgcttccattcagtatgggagcgcaggaggtggatcagtcggtggaaaaacgtatcgattccttggctacggaagtgactaccttggataaggtagtccagaagctaagcaaattcaaggtttccgcttatatccaaggacaataccaatatggacaggaggacgctaccttgaaggtgggcgataagaacgagaacttggataaagggtttaaccggatcggtatccgccggggccgtatgaagttcgagtacaatgatgggatcggaacaggtgctgtccagatcgaggtgaatgataagggagtaagtttccgtgatctgtatattggtatcaaggacccttggacgaagcgtagccagttgatggctggtgtgttcaaccgtcctttcggttatgaggtctgttattccacgagttctctcgaatctccggagagagcgactattatccagtatttcttcccggatgagcgtgacttgggagcgatgcttaccttacgtaccaagactaccagcccattgagtttcttgcgattggatgccggtctgtttgccggaaacagtatcaaccgggagacggatagccggaaagatttcatcgggcgtctgggtgccgagaaggcgataggcgactggggaaaatggggagccggtttctcctattaccatggttttgtctacaacccgactaccgaggcgtatgagatgcgtggcaatcatttcgttaagagggatatgggagagacgggtacttatatgaagcgccagtatttaggtttggatggacagtttagttttctttcatctttaggaaagaccactctccgtgcggaaggtttgatcggtacccaacccggtatcgccgggagcagtaaaagcccgaactacagtacccgaccggagaatttgccggaaaattctttgtttaagcgccctttccttggttacttcttttatttggtacaggatataggcgcctctcctttctccgccgtattgaaatatgacgtttacgatccgaatacgaaggtgagtggaaatgaggtaggggcggaaaatagcttcacctcaaaaaccgatttggctcaaagcacgataggtatcggcggtatctataatttcaataaacatatccgtctacaagcttactacgagtttaacttcaatgagaaaagtaatctcgtgaagggctacgagaacgaccggaaggataatgtattgacagtccgtcttcaatataagttttaattcataggattgtaatatctgtttcatcccattgaaataccgaagtatttattttgtatcgtaaataaaagataaatacaaagtaatgaagaagacgattttattagctgccatggcagcgtgtttgtttgctacgaatgtgtttgcccagaagataaagggtagcgatacttgtttgcctcttacccagactgaagccgagaatttcatgaataagaacaaagccgctaagataacggtgacgggtggtggctccggcgtggggatctccgctttgatggaaggcactacggatatagcgatggcttcccgtaagatgaaattcgacgagcgcatgaagttgcaagaagccggaaagaagacgaaagaggaggtgatcgcctatgacgctctggctgttgtcgtgcatccttccaacaaggtatccaatctgacccgggagcaattggaaggcatttttaccggcaagatcaagaattggaaagaagtgggtggtgcggatatgaagatcgtggcctattcccgcgagacttcttccggaacctacgagttcttcaaggagagcgtgttgaaaaataagaactatatgaacggtatcttgagcatgccggctacaggtgccattatccaaagcgtaagccagacgaaaggagccattggctatgtaggtcttgcttatttgaataaagaagtgaagccgatccatgtatcgtatgatgccggaaaatcctacgtggagccttcgttggagaacgcaaggaataagacctatccggttgtccgtccgttgttctactactatgagacgaagaatgcctcaaaggtgcgaccgttcatcgattatgtgatgtctgccgaaggacaagcgacggtgaagaaggttggttatatcccggtaaagtaagcggagaatccggacagcgttgtatgagcacatcatacaacgctgtctaaggtgcttcgacagtactgtctaaggtgttaagacaacgctgtcttatgtgttgggataagattgtccgtccgtctcttccagaaactgatccatatacagattctcgccatcccatacgatataagagaagaattgcatccaatccccggctatgagaatacgggaggtacggcttaacatcaagtccaacatgatgtggcgatggccgaaaatgaagaagtttatatcgggatgcgtctttagatattccttggcgaaaacaaccatatattctgcgtcttccccttgatactttttagcctcttgcttttccagtccactcttccggctgttgagcgaccaacctaaagcgaacccgaacgtccagcggggatgtattcccgcgtatagccattggcagaacttgtttcggaaaatggccctgatcagacggaatgccttactccggaaatctacctcatcgccatgcccgaggaagaaacgtttccccaataaatcgactgtcaaggtatcccgatggatgatggcgcctatctctttcggcaagtagtcgaacatccagatgtcatggttaccgataaagatatgtatttctatgcctctgtccgctaactcggccaatttccccagaaaacgtacatggcctttcggcacgacgtatttgtattcgtaccaatagtcgaatagatctcccagaaaccaaatggcggaagcgtcttccttgatgctatccagccaacgtaccagtttcttttcgatggctaaagggtccttgtggaaacgggctcccagatgtgcgtctgaggcgaaatatattttcatagaaaacctaattccagtttagcctcctccgtcatcatgtccttgtcccattccggctcgaagacgaggtttacctctacattgttcaccccatcgaccgcttctaccttcatacggacatcttccaatatgaaatcggccgccggacagttcggggcggtgagggtcatatcgatgcgtacatttttttcctcatcgatatctaccttatatataagcccaagatcgtatacgtttacgggtatttccgggtcgtataccgtcttcagcatagcgacgatcgcttcttctgtttggagaaattcgttgttcatcttcttttgttttatacgcgaatatacattaatacttctatatactaaaccgggggaaaagagaatttgtttcaccggaccagccttccttcatccgcatagctataataaccgctatcggacaggatgatatggtccagtatcctaatatccatcagcttcgccgccttttggatacgctcggtcaaggcatcgtcgtgcgtactggggcggaggctgccggatggatgattatggcataggattataccggaggccaaggcgttgatcgccgcttttaataccaaacggatatccacggaagtctggtttactccgccctgactgatttttaccttttgtatcaccttatttaagggattggttagagcgatccagagttcctcataaggtaaatcgcatagttgggtacggaataggagataggagtctttgctgcttcggatagcatcttgaggagatgcctctgaggtttcccgccgtttccctagttccatagcggcgcagatcgtgaccgccttcgcctctccgatacctttaaagccggaagttaattctttgatggaacgtttacccaatgtattcagattgttgtttacggagtgaagtatccgttgagagagttgtacggccgtctcctcattgttgccggatccgatcagtatggcgatcaattcggcatcgcttaatacggaagcgcctttttgaagcattttctcacggggcctgtcttcttcggcccattccttgatggaaagttttcctgtcttttctttcatagtcgggaaaggtttatgatttggttaaaaaaatagttcccgcctgcttatcaagcgggaaccgtatattttgacaagacccggattactcgcggatacggcctacgtaagaaccatcagtcgtattgatctcgataatctcgccctcgttgatgaacaacggaacgcgaacttccgcgccagtctctacggttgccggtttcaaggtgttagtagcagtgtcacctttaatacccggttctgtataagtaacttttaattgaacttttgtaggcatgtcggcgaaaagaaccgtatcggtagatgcatcagaaacaacgtctacaatttcgccctctttcatgaaatcaacgccgttgatcaagtttttgtcgatgatcacgtcatcgaatgtctcttggttcatgaaatgataatgctcgccttccgtataagtgaactgatacgggcgacgttctacgcgtacatcttccaacttctcaccgatattgaaacgacgctcgatctgaccgccttttacaacatctttcaatgtggtacgcatgatggtattacctttacccggttttacgtgaaggaaatcgacgcagaaatagagttttccgtccaaacggatacaagttcctttcttaatgtcttgtgaattgatcatatttattttctttatttatatatgttatagagtaatccgtaacgtttttcgggtgcaaaagtagtactttcctgctaaagtagcaaaaagttttgcgtatttatatggaaaaatagttgcaaatcaaccgaataaccggaaccaagaccgctgtcatgatacccatcaagccaatcgccagtccgcttaatgctccttcgatggccccgatttgaatggccgctgctgttcctactccatgggaggaagcccctaacgccagtcctttagcgatatggctatctattcccagtaccctcatcacgatagggcctactatactgccaaagattcctaccgctacgacgatgacggcggtaagtgaaggtatgccgcccgctttctccgctatccccatagcgatcggggtggtgacggatttcggttggagcgtggcgatcaacgcttggtcggctcccatcaatttaccgatgatgattacgcttacgattccgacaatggccccgacaaatacggaagtcaagatcgaaacgacatttccctttagatattggatttgctcatataacacatagccaagggccactacggaaggccccagcataaaatggatcaaatgactgctttgctggaacgactcatattgaatgcctaggacttccagtaccacgataatcacgaagatggtcgtaagcaaaggatgcaaaagactgatatggactttcttgtaaagagccaaggaagtcaggtaggtaccaattaccaaggtaagagcgaaaatctcggaatgcgccagattatccatggtctattttcccttttccagtttttgttgcaccaacgctacgctggcgatgactaaaattgtacttactacggaagcgatcagcaggactgcccaatactcggagatgatcccgaaggaattcataagccctacaccggcaggaacgaagaataatcccatgttttgggtaagaaccgtggaaagacgtttcaccttttcaggttttactttcttgaacgcgagggctaagaacaatagcaccatcccaattacgctacccggtatgaaaccgtcgataaagtagctgataaactctcccgtgaaatagaagaagagaatgtaaaatgcttctgttagcatagtttttctaccttttttgataaccgctacaaagataacagctatttcgtagatatgttctataacatattattttaacattgtagggacggacgccgtccctccgtggcatcaagctaacgcagaagtaatgaacatataaatcatcataccgataatatcgttggtaatggtgataaacggtccggtcgccaaggccggatctatcttcatcttatctaaggtcatgggaactaacgtgccgaatatactggcgaacattacgacggcgaataggcttaaagatacggaggccgtaatcccccggtctcccagcatgaagaagttgtaaatgaacacgaccagactgataatgctggcattgattaacgagactacggactcttttaggatttgcggtacgatattcccttccttcaaggtattgtttgccaagccctgtaccacgatagcggaagattgtatgcctacgtttccaccagtaccaccgatcagcgggataaatagcgccatcttcgggttagtggcgaaactgctctcgaaaccaccgaggataacggagtttcccaatcctccgatcatgccgatcagcagccaaggtaggcgggcggcggtttgggtgaatacattatccgaggtttccacgtcttgcgagataccggatgccaactggtaatcacgctcgtgttgctctcgtacctcatccataacgtcgtcgatcgtgatacgtcctaccagacgtccgatactatcgactacgggcaaggctaccaagtcgtatttctcgatcgtctccgtaacctcctcgatgctgtcgctgtcgcgaacggagatcgggtcttttttcatgacatgcttgatcttggagacggatgggtgggtaatcagtttctgcaaggggagcacacctttcaagcgctcgtcgtcatccactacatatacataatagatctcgctcatctcctccgcttgcttgcgcatctcatcgatacatttgggcatactccaattctcgttcaccacgatcatctcggtacccatcaaaccgccggcggtgtcctcgtcgtatttcaacaagtccacgatatcaccggcctgctctacgtcctcgatatgcgaaaggatctcctcttgggtatcctcgtccaactctcgcatcaagtcaacggcatcatccgtttccatgttatcgacgaaacgcttggcgataagctcattgggaagttccttcaataatttatgacggtcttcctcatccagctccatcaagacatctgccgctttgtcgccatccatcaatagatagagataaatggcctcttgcaagttcagttcttgataaagctcggctatatcggcaggatacagttcatgaagtacctcctgtgccttcgcatcatctttggcctcgatgatgcttttcaggttctcgatgtaatctttcgtcagttcgatcattggactcttatattattataggacatcaccagcctgcttctccaaatgcttttggctgatcaaggtcagttccacgaattgctccacggataactgttccgggcgcttgtcgaatatcgacaaggcgtaatccgggcaatctttacccaataggggtttcatggagttacgaagcgttttccttcgttggttgaatgaggtctttactacggtcttgaataacttctcgtcgcatcccagctccttgcggtcgttacgagtcattttcaatacggcgcttttcacttttggaggcggatcgaatactttctcactgacagtaaagaggtattccacgtcgtaccaagcttggagcaatacgctcaagattccgtacgtcttgctaccgggacctgccgctaggcgttccgctacctctttttgtaacatccccgagcagcagggaatctggtccttataatcgaggactttgaagaatatctggctggagatattatagggataattaccgatcacgcaaaactcacccgggaatatcctcgagagatccaatttcaggaaatcctcggcgatgatacgtcctttcagatcggggaaattctggttcaggtaatctacggattccatgtccaactcgacaacggtcaaatcatgtcccgcctccagcaagaactgggtaaggactcccattcccggtccgatttccaagaccggcaaggatttgaaagtatcgagtgtgtccgcaatgcgctgtgctatttgcagatcctttaggaaatgttgccctaatgctttttttggcttaactaatctcatccacttttcggtgtaatgtgtttgtttttaaatattatgcttatctttgcggatgcacaaaagtacaataaataatttaaagttccctatacctaatggattttaagagcattctacgtacgtttctgaagataattctacctttagccttcggctgtttactcctttggtttttgtatcggaaaatggatatcactgagatttggcgagtagtcaaggagggggttcgttatgatattattctggtttctttactgttcggcttgttcgccaatatcgtccgtggtttacggtgggggttgctgatcagttccttgggcgagcgcttcaagatgagtaacgtgatttacgccgtgctgggtaattacgccgtgaatctggtgttgccccgtgtcggcgaggtatggcgttgcggcatgatcacgaaatacgataagatctcgtttaccaagcttttaggtaccttattgatcgaccgtgtgagcgatacgatcatggtcggtttgataaccttgatgatattcatatttaatataagcttctttacgagtttcttcgctaagaacccggctttgctcgaagggttccaatccatgtttaattcgatatggatttacgtggcggtgataatttttgtcgctgtaatttggtttgtattcacttatatgagtaactttacgctggtacagaaagccaaaggcatgttgaggaatgtgtggacgggtatgaagagtatctggtacatggagcataagatgcgtttcgtgatagagacgttattgatttggggaggttatttctgttacttttatattacgttctatgctttcgactttaccaaggacttgggtatcgtggtcgggctgatcacgtttacgatgagtagtatcggcgtggcggtgcccgttcaaggcggtatcggaccgtggcatttcatggtgatcgctaccttggtttgttttggcgtgaacgagaatgacgcggcggcgttcgccttggtcgttcatacggtacagacggtatggactggattgtgcggattattcggcgtggtggctttgccgctcaccaaccgggagaacaaagaggctccggtcgctgtttcgtgatgaatacaagatatgtattaaatatgaactgaactaaattattaacatctatgtcagcagaaatcaaagatctatctccgaagcatgtatggggttatttttatgaccttacgcaaatcccccgtccgaccggacatatggaggcagtaacccgttttatgatatcctttggtaaaggattgggattggaaaccctgcaagatgaggtgggtaacgtattgatccgtaagccggctacgcccggaatggaaggtcgtaagaccgtgacattgcagtctcatctggatatggttccccaaaaaaactcttccgtaaagcatgatttcgagaaagatccgatcgacgcttacatagacggtgattgggtgacggcccgtgagacgactttgggggcggacaatggcatgggcgccgctctggcgatggccgtgttggcggacaatagcttgcgtcacggacctatcgaggccctgtttacgattgatgaggaacagggaatggacggcgctttcggcttgaagccgcatttcttaaagggtgatattttattgaattgtgattccgagaaggaaggggagttgttcgtaggttgcgcgggtggcgctaacgtgaatgtctctttccaatttaaggaggatacttatattccggaaggtgacgtggctgtcaaggttagcttggctggcttgaaaggtggtcattccggtgtggatattcatttagggcgtgcgaacgcgaataagttgatcttccgtttcttgaaagaggcggtatgcgattatggcgctcgtttgtcttctgtggcgggtggttccttgcctaacgcaatccctcgtgaggcttttgccgtgataacgattccgggtgataacgtggagtctctttgggagctagtggctgattaccaagatatgttccgtacggagtatatgggtgtggaggatcagatcgatttcgtcgcggagatggttgaattgccgtctacgttgattccggaggagatacaggatgatttgatcaatgcgatcgaaggttgccagaatggtgtgattagcatgttgcatgatttcccgggtacggttgagtcttcctctaacttggcgatcgtgaagacatctgatgagttgatcgaggtgaagatcttggtgcgtagctcatccgagtctcgcagggattctgtttgctcaagtctggaaagtgtattcgctttggcgggggctaaggtggaggagtccggtcattataatggctggcagcctaatatcaattccccgatcttgaacttgatgaaatctacctatctggatttatttggtaaggaacctgaggtgaaggtgatgcatgccggattggaatgcggtatcatccaaggcgcttatccggatatggatatggtttctatcggaccggatttggaatatccgcactcaccagacgagcgagtgaatattcattccgtacagaagatctgggagtttattacagctacattggagagaatctaaggatctcctttctttatagatattaaacaaaccctccagcctttgttcttctaaccattcggttagcgagaatagggctggagggtttattttatagtttctctatatcctcaagggagagcccagtgtatttttggataatagagggggataatccatccgctttcatgttacgggccgtagattctttccctttcaatatccctttctcctctgcgtaatcgatcgtattcttataatccctgtatcgtttcagggcctcgtcgtattgtatgcgttcttccttgctgaggtttgccacgtcggctacttctagcaacttatcgaagaccgccttttttgccttgaacggcattctctctaaagtgtccatatgcttcaataaataaatccaacgttcaaaatcattctcgcactcgtccggttctttttggaagtaaggcagctcgagatagacttgccgtatcctgtcgctgaacatccttccggtttcccggtccgccaatataacatcggtccggaactttgagttcacgtccatcttgtaattaagtaggaataccccgtatacgggttgtaacacgaatttccagtccttccctttttgtccttggttactgatggccctcgccagatagtacagtcccctgtcgtggaaatagggttgtgccccggtttgcatctcaacgacgaataggtttccgttgctgtccttgcaatgcacgtcaaaaacgattcccctgtcatccagcgtctcgggggtctgaatcgggttaaggaacgtgatatcctcaatgtagtgctctccgaagaacaactggttcaggaaatcgattagtaactccttgtgtacctcctgcccgaatatccggtgaaagccgaaatcggtgaagggattgataaattttcccatagtgcttataggtttaaatgattaaatgattaaacggatgatcctatctcatcctttgcggtaaagatacgcttttttttaaaaggaggcagggctggtgtgccaaaagtttcacttttgtgagatttgagtgttttttgaaaatacgggaaacatgtgctttacaggccctgataaccaagaaacgggccctctcattggctgctgaagtgaataactgacggcttgtcgagtgaataactggcggctatacctagccgctaactgacggcttggaaagtgaataactaatcacttggaaagcctttttataccggaaccaacaaggtcttaacgcgtacctttgcaaatgactagaaaaatcgatcgtttagactagtcgtttctcacattctattccatcgcacataaaatatacatcacctatatagtagtataacctctatgcgtattgcatatattataatgtacgagcgtacattatatattatctatgtcgttgactgattatcaattcttctttctaaatccaaataagcatgcttatcggataaggtgaatttgaatatttccagcagatacaccgagcattatccgccaacagtattatatacggattatcagcatattacatttacaactagatgtaacgctgtttacttccatatgtaaatgactttacttctagaggtaaacactttcgtttctactatatgtaaatactttcgctcttgcatggaagcgcctcgtttacgcttttattggtcaaaataacgactatcctatgtacttgaactcttttttcataaatttgtcgctttataataaactgagtaaaaaatgaatacacacgaactttgctgcgtaggacacatcaccttggataaggtagtgacacctaagaataccgtccatatgccgggaggaacctccttttatttctcgcatgcgataaaacatttcgatgatattgactatactctagtgacagccttggctgaatctgagatgaaaacggtggaggaactacgagccgaaggtatcgacgttgccgtgatgccaagtaagcacaccgtttatttcgagaatatttatggagagaaccaagataaccgtacgcaacgtgtattggcgaaagcagatcctttcaccgtagagtatctggagaacatcgactccaagatcttccaccttggtagtttgcttgccgatgatttctctttggaagtggtaaagtatttagcggggaaaggcttagtatcgattgactcgcaagggtatctacgggaagtaagagacaaggatgtatttgccgtggattggccagagaaaaaagaagtacttaaatacgtgcacttcctcaaggctaacgaacatgagatggaggtgttaaccggatataccgatgccgtgaacgcaggaaaagttatctacgattggggcgtgaaagaggtattgctgactttcggaagcatgggatctatcatttacgacggttccactttccataaaatccccgcttacataccgaaagaagtagtaaacgctaccggagcgggtgatacttatatgacaggatatctctataaacgtgccaaaggcgcaagcatagaagaagccggacgtttcgcggcagctatgacaacattgaaaatcgaaggaataggcccattcaacggcactaaggaagatgtgttgcgatgcttagagacagcggaacaacgaatgcctgagtagttgaaaattgagaattgaaaattattcgctctctcctaattttcaattctcaattctctatctttaattattcttgaatgctttgcagaatgtagtcattagcaagatacaaagccctaacaagccgaccacgatataagcgtatttcatattgaaagcctgcgagatcgctccgatcaacaaaggtgcgatcaacgagccgataaagctgatactggaaaggatcgtcaaggcaattcccaccggagttctcgatttagcgcccactaagctataaatagtaggcaccatacacgagatgcccaagcctaccaacataaagcctaaggaattcacgatcaccttaaccgtcatcgattcgaacattccacccaacatggctgagataaagaaacctgcaaaaataaagaaacccgctaattgcaacaccttctgctttcctaaaacactataggcggagttcgtaagaaaacggcctaccgtcatcatcaccatgaacactaagaaaccgatctgcaaggatttaggaacttgtagtaccgattcgaagtaaagtccactccaatcaaacatcgcactttccaccaccaaggcaaacagtccgacgatacctaactggatcaacagtatttccggcttacggataaagctcaacaatgccggagcttctttcttctccgcttccttctcttcctccggtgactcaaccgccacgtcttcctgcaaatacttccggcttaccaaaacagtcactccaatcaataatgcaatcaacgtaaaatgccagaacggagtgacgccggatacgatcatgataaacccgatcaaagctcctaaacaggccgccagactccaacctccatgaaatgaggccataatcgtacgtccatagagccgctcgataccaatcccttgcgtattcaaggatatatcgcaaagattccagaacaccccaaaacagaataaatagacacccagcagataaatattatgtgccgtaccgatcgcgaataaggccaaggcatatcccaacacactggcctgcgccataatacggcttcccaacttcgacaccaaataacccgctaacggtatcgccacaaacttacctaccgggatcaggaacaagaccaacccccaatagaaagcgtaattcacctcaaagaaatccttcacgtccggaatacggctagcccaactagagaaacaaagaccttgcgctaaaaagaaagaaagcatcgcataacgaacccgttccttgggaaaagcgctacccaatggagtattcattttttcattcattatcatttacttttattgttatcatctattcgagaaagaggcacgaaccccattcctccgcaaagctatcaaatatatcctaatcccctaagtcctaaaagtagaatttattaggtagattccctaatgaaaagtatatttgcgaaatatgcacaggaatgttgactaaatcgaggatgatatgagaagctggattatctttttaggattattatttaccacattcacacaggcacaagttattacgggaagggttacggacttaaataaccatcctatcgaactagcggtcgtgattatacaaacgaacgattcagtatatgtaaactccacctatacggactctttgggctcttttagtgtcaaagcggagatatcccctttcctcttaaccgtccagcatctgctgtatgaaacgtatcaaagcacttatgactcacttacgataggcaatatacaactgaacgagaaaagccagacgctttcggaagtatctgttaccggagagcgtcccttagccaaggttgtcgatggtaaaataacctacagcatgccgcatttgttaaaagacaagatggccgttagcgcttacgaagcgatcctagaactaccgggagtgcgggaacaaagcgggaaaatacaacttgccggaacaaatggagtcacggttatcatcaatggcaagaccaccaatatgggtgagagccaattggagaatctgcttaagaatatgcccaaagaacgtattcaagaagcagagatcatgtatagcgctccaccccaatatcatgtacgcggggccgtgattaatctggtccttaataacggtacttccgagactcccaaactgcaaggacaagtcaatgctctatacaaccaagggcattacgctaattaccaaagtggcgctactctcgtttacaacacgcctaaatattctaccgatctcatgtactccttcggctaccacagggaacggacaggtgaggatatcttatcacaccatttattcgatggtaagacctacgagatcgagcaattcgacagaggacatacccggctcccggtccataccatacgcctaggcaatgattggttcttgaacgataagaacaaactaagcttcgcctatacctcagagatccagcaatggactcatcctttcacctcttctgtaggaacctattcggattccgaaaacagaaagaaatccgacaaaccgatccagatgcataatctggcgctcgactatgcctccgggttcggccttaatgtagggattgattttaccgcttacatcaatcatacgacacaatattaccaagagaagaaagctgggaaagaagatgccttcaacgctaaatcacaacaagacatccgtaggctctccgtctacgcggaccagaaccataaattaggaaaaggctggatgctcaactatgggacaaaattcagcttcgcctcagacaaaagttctcaggtatatcattcactgcgcaaacacgattggtccatctctaatagttacagtaaactggatgaatatgtatatgatttatataccggcttttccaaaagcttctctgataacctatccgtaaacgcctctttgaccggagagtattacaaacataaggagattgattattggagcttattcccaatgatggaaatcacgtaccgagcccaccccagccacatcctgcaattatccgtttcttcagacaagacctatcccagctattgggagatgcagaatacggtgtcttatctgaatggatataccgagatacaaggtaacccggatttaaggccgtccagactctactctgcccaattgaactacatcctaaaaaacaaatacattttcacgctatacgcaaattatatagacaataatttcaaccagctcccctatcaatcctccgagagactagttcttatctataagacactgaatttcgactattccagtaagctaggcctaaatgtaatgataccattcaaagccggctccgtgcttgattccagattaacgttaaacggttattatgacaagatgaaatgtgataattaccatgatataagcttcaataaagataatctggcattctatgccgaattaaataatacgttcaacatctcatcgaagcctactatcaaagcggaagtatccggttcttatattacccgcaacattcaaggccaatgacgatcagcagtatgtataacgtagacgccggcttgaaatggatctcccccaacggcaaagcggagatctctttaaaagtggatgacatgtttaattcatgggtcccaaaagatcttaatctccaatacaaaacacaagacttacatatgcgtatgatcccggattccagacgagtctccttatcctttatctataaattcggagattttaaagctaaagagcataaagaggtggatagttcccgattcgggaaataaaagtcgatggtctatactacgctttcaacctatattcagacggggtgacattaaacttccgcttaaaggcagtacaaaaatgcgcttgatgttcataaccgaccaagccggcaacttcccctattgatttattggtatccaaaagatagtgaatcgctatattcatacgataatcaaagagatagttaaacacggtcgtccggaacgcttctttaaaccccgctttcaaagtacattcattagttccgacacgtaaagccaaatcatgtaatgaaggcgggttcaaatattcggaacatataatatcccgggcctgataaattttatcccgatcggaaaagcctactatctttgcgttaaccggttctttaccttccgtctcccgcataaataaagacaagcactcggttacttttgcttcgagatacattggcgaggcatttcccatcatctgagagacctcaagatcattcaacgccacagataaagcgattggaatcgagagattcttgggagcgataaagaaagtctcccccctgccgaatcgcaaataagcactcccgaagtactccgtataacgttccgacaaatgttggaagaaatccggcgacaccagaatacttgtcataccaaaagtatctcctttacggaacagattccgctcttccttgataccagaacttacgatcatattcgtataccctttccgccaaatccgcttatcccgtgtctccgacaaaaagcattcgacgatcccctgacgaacaacagaaagtcccataaacgagttaccgacatttagggaacgcatgcaacaatcctccttgcaatagatctggtatcttgtcacattaaaatccctgcatctgaaatcactgatacgataggtcaataatttgttctccgcctcccaacagttctcttctagccctcctgaacgattggtagaaaaataacttatatccggcatttctaaagcgatcgtatctcttccacgagatgagagttctatgtgtaccatttttccgtttgattaaaatacacttccttcttgcgtaaataaaccaaaagcaaagatcccatctttgtaccggataatcaatccctataaataggtatattatgaataaaataaaaccagagataaaggatgacatcgcggagaccttgtttattcccttactatcacgcgctcacgaaagtcaccggaaagacgcgatattaaaagacccgatggcatgtgagcttgttgagaaaatagattatgatttcgccaagtttggtaaaatcacgatgagtactaccggaaccactatccgcctacgccatttcgatcgtttggtccagcgattcatcgaccgtaaggtaactgaagatccggtagtggtatcgatcggttgcggattagacagccgtttccaacgtgtctccaaccataaccaagcgaccttctacgaactagacttacctgaagtaatcaatttgcgtgaaaagctattccctgcctccgctaaagatctcacgatcaaaggctctatgctcgagacggactggatggatatgttgagacaaaaacatcctcacggccgcttccttttcctcgcggaaggtgtaatgatgtatttcaatgaggaacaggtaaaatctgttatccaaaacctcgcccaacgctttcccggatgcgagatatattttgatttcgtcagtaaatgggccgcccgcaactccgacaagcatgaatcggtaaaacggacaaaagcccgtttccatttcggactaaacgatccgcacacaatcgagcaatggttccccaagctcaaactgatcgaacgattctatttcatcagcgaagagaaaaaacgctggggactacccggcttgatcatgtggttaatcccggcgctacacaagtcttttggaatcgtaggttataaagttggagaaataagtaaataggttatctaccaaataaaaaagctagttctgtattcgatcatgagttttggtattaaatagaagacctccacgtagtttatcagaaggactttccgacaattgtaccccctttttgtttttcggggaagggggtacgatttggatactcaaccgtatcttttcgtgcgcctttttgggctttcaagcaagactaaaacataaaaaagtcccacaatacgttaatattgcaggacttatctcttttagctttgttcttatgtgatccgcctggggctcgaacccaggaccccaacattaaaagtgttgtgctctaacccctctttcaagaatgaaaatcttgcgtcctagccgatagacgaatgggccaaaatgtcaaagctctcacttatagcgttctaagaaagtgatttcccgattgcgagtgcaaagatagacgatctctccgaactggcaaaacatttcgaaggaaaatttaatactactcactgttttaacttctctttagaacttatatcttccagatgaatttccaaggctttaacggaaatatttatttcccagatacatacacataacgacgccgctaatagcaataaggctatgccaaatatccatgcggcgaaaatctgccacgatacataaatgaagaacatagcgatcacgcagagcagcaaactgagtattcctaatatttgcatggaacgggtcagatagagccttttccgcaggttcgctatctgggcgatatccttggggtcatgggtttgctgatgcttttctttcaaggcacgcactacgctggcgtatgaaaggaagcgattcgtataggccaacaatatcaatgatatggcggaaaataataaagaaggggtcgttaagtccaacataattctatactttaattatatgtataacgttaatttgagtatctttgttcttaatcatcgtcgcaaagatacgaattatgttgtgtaaaacgagggggattgtcttgcatacgatcccttacaatgataaatattctattatatatatgtatacggaggcgtttggccgggcctcgtatctggttagtcgtagccgtgggaagaaaagcacggtgtcgaaggctttgtttatacctttgtccgttctggaaatggaggtggagcacttgaataagcgggacttgcaccggattaaggagacccgcatttgttttccgctgaatgatgtttgttgtgatccggttaagaatgtattggcgcttttcctctcggaggttctttttagggtcgtgaaagatacggagtcggatccccgtttatttgattatttatacgagtccatacatctattggagtatgcggataagggtatcgctaattttcatatggttttcttgttaggtcttctccaccatctcggtattttcccgaatatggaatcgcatagggtgggatattatttcgatatgttgaatggggtgtttacggatcatatcccgatgcatcggcattatttaaataaggtggagagcgctttcttttcccgtttgctgcgtatcagttttgagaatatgtcgctttatggtttttcccggcaagagcgggtccgtattattcatcgtattcttgagtattaccgtctacatctcccggattttccggaaatcaaatcgttatcggtgatgcaaagcttatttgattgatctatttgatgttatattagctcttgaaaacacgtacgtgtttcttgaaaaagacgtacatgtttttccggaaacacgtacatgttttttcggaaataatgagaagcttccggataggcgggaaaaacatccgataacggttgcctatttgaggaaaagattatacttttgcaatctcaaaagagttggtcttgtagttcaacggatagaatagaagtttcctaaactttagatccgggttcgattcccggcgagactacttttgtccttctttctttttatcttattttattaatagatagcgagttatatttgacttttgagtgttttgtatatcgtttttgtaaagagaaaataaataaaagaagattttttcttaccgcaattcttaccgcatccttgttttgtcgataaaatattgtctatatttgcgtaagttaaataaacagatatattatggcaacagtaaaattctatttgacacgtccgaagtcagataagcctaccgctattttttttctgatgaattacggtgcatatactattttacccgatgggaagaaaaagtacttaccgttgaagtattatactaatgagacaattttgccggaaagatgggatacgaaagttggtgctccgatcgctcctacagcgaggaatcaccggatgaacgctggtgagtatagagaactgaaagcggctttggataatatcgaagttacggctaaagatgtgctacgtcggttggagaatgacggtatccagccaacgaatgagctactaacaaaggagttggataagatatttaaaggttacaaggagatagaaccggatagagatgtcaaggatttactttgttttgtcaaatcctttatagagaaaactgataagaaacctaatactgtgaaggggtataagcaaacagctcgtgagattgaggggtatattgcattaacagggaaaaggctacaatttgagaatgtagacttggatttttatttgtcatttgttgaatatttaacgaataaaggttattctccaaatacggttggtgctcgtataaaggatttgaaaatgtttatgaatgaggcttatgaacgtaatctacatacaaatatggatttcaaaaagaagcgttttagtaagcctaaagaggaaacctattctgtctacctcaatagtgatgagctaaagaaaatctataagtgtgacttaagtgatgaacctcgattggatcgggttcgggatttgtttttgataggctgctgtacaggattacgttttagtgatttgtctttgttgagttctgataatattgataatgtagagagtgtaattactataaagactgtgaaaaccggtaggactgtagttatccctttgcatgcgatagttcggcagatattgcagaaatatgataatgagttgcctcgtgttccttcaaatcaaaaatttaatgattatatcaaagagattgcgaagaaggctgagattaatgagccaatcttattgcaaagaacaaaaggtactttaacttatgctgaaacgaagcctaaatatgatcttgtaacgagtcacacggctcggcgttcttttgccacgaatgcttatttagcaggattgccacccattagtataatgaagataacgggacacaagacggaatcttcattcatgaagtatattaagatctcggagaaggagaatgctatacagttgaaaggacatgaattttttaatcagatagtaacttgctaattgattatttttatggaaaatgtaagatcgtattgtgatgatattctagatgttatacataaatttggggaagagtatatctatgaccccagaactaaaatcattgatgggaaagatttgtttgtttctgttgataataatatcaataacgatattgcatactctgatgattcggacaatagatcgaatgaggcttgtgtgaatttgggtttaacttttgcggttggtcaacattgtgagaaattacgtgtaaaatatgtagatgcgataaaatctcgattgttagggatggatcctaaagctagaatggtctatgcggaggaaatattacagcgtttatatgaaatacagctaaatcatcccatttttcattccaaagtatttcaaaagtttgttataccaattttcttctcagatgtcacagaagcttttgaacgatatgatattaatttgcgaaatgttctaattgattgccaaaaaaggcatggtacgttcttttgctattggttaaagttcttcaaaccccattctgatacgataggggtacaaagatgtatttatagtgaaagtgatattattgatgattcgtcagatgattctcaagatgaactattgaattactctcaaagtgaactgtcaaatgtttctgataacggtagcgatagatcatcaagctatggtgaaagtgatattcatgataattcgttggatatttctcaaaaagaaccgttgaattactctcaaagtgaactgtcaaatgtttctgaacccgattcccttttaatccacatacccgaatggtatatgcggaaccgattcgggaacaaagatagcatgttttccgtatatatcatatcttttcgcttttttgtttacttttattatccaaataaaaaaatcccgggacaaaacaattgaaccgggatcttttaacctctaagctatcctcccgacaggaagaggctttgattttccttaaataataattactacaagggaatatttccatgttttttaggaggattactctggctcttatttttcgccatttccaacgcctgaatcaatttaaaacgtgtgtctctaggttgtatgacttcatctataaatccttgctcggctgcccggtaaggatttgagaatttctcggtgtattcatgaattgcttgtttcttctcctcatcgttggctttccggtataatatattcacggcaccttcagcccccatcaccgcaatctcagccatcggatatgccaagtttatatcggcaccggtaggcttacttgccattacgatataggctcccccgtaagccttccgggtaatcaacgtgattttgggaaccgtggcctccgcataagcgtagacaatttttgccccgtggcgtataattcccgcatgttcttgcgtacagcccggcaagaagcccggcacatcctcgaacgtgatcaatggaatattgaagcaatcgcagaagcgaatgaaacgtgcggccttatcagaagcatcgatatccaagactcccgctaaaaaggcaggttggttccctacgatacctatggtacggcctcccaaacgagcgaatcccactacaatattgcgagcgaaatgaggcataacctcgaaaaagtaatgattatccactatcggctctataatatccttgatgtcataagggacattaggatcttccggaatcacatgctgcaacgactcttctacccgacgcacatcgtcagcacaagctataactggagcgtcttccatattattagaaggcaggaaactcagaagttcccggatactcatcaaagtctcctcttccgtatcacacacaaaatgtgcgaccccgctttttccgctatgtacctgcgccccgcccagctcttccttatcgatcacctcgtgagtcaccgcctttacgacatccggccccgtgataaacatatgactttgctctttgaccataaaaataaaatcggtcaaagccggggaataacaagcgccccccgcacaaggccccaaaatagccgataattggggaacgactcccgaggccatcgtattttggtaaaagatagaagcataaccagccaagctattcaccccttcttgaatccgggcaccccccgagtcattcaaggcgatgatcggcgctccgttctttaaggctaattgttgcactttcacgatcttagcggcattcgtggcactcaaggtcccaccgtatgcggtaaaatcataagcgtaaacaaataccaaacgaccatcgatctttccataaccacttaccattccatcaccgggaatcttattcttatccatcccgaagtttgtacaccgatgcaccacgaatttatccagctcattgaaagtccctttatccaacagcatctcgattcgttcacgggcggtcatacgcccgcaagcatgttgtttctcaatgcgattcaatcctcctcccaacgaggcctctttattcaaagcctcaaaatctttatataattgctcgttattcatatgaatcatcttttaataggtctaaagtcataagcacttgattgttatcaacggaatctccctcggataccaatatatcttttaccacgcatgctgagcttaccttatagttactctgcatcttcatcgcctcaagtacgaccacggtatcccccgtttccaagcgatctcctttccgcacaggtattttcacgactttacccggcatcggggcgacaatcttgtcatcttgcttctcttccgcacttttacgcatacgcaaatatttcttttgggtatctacgatatccacatgataggaacggtagaacatattcacgtcataactccgatgatcttctccggagatgatctccgcgttaaatgagttcccatcgtgcaagacagaacaactgccgttctccgtcatcacgatatccacatcatacggcttcccgtcgatagaaagccggactttattcccttctttactgaccaatgtcacatcggccacacgatttccgatatgtatttccataaccaatacccgttaaatccgtaagacacctttttgtaaaccaaactcccgccaacggctgataggacgtgtatccaccaattgggtagaagtattttcctctaaattcatcaaataatccatataagcggcgatcatggcgatattctcgatttcctcgttattaccgttagaccgttgtagcatccgggcattcttagcgataaataatgtattatattcccctttcacgaaatcaggattatgcatgatacgtttcaaataactgaggttcgtctttaagcccgtgattttatattcatatagaacccggcgcatacgctcgatcgcatacgcacgtgtcgttgcccatacgattaatttaccgatcatagggtcataatagaccggaatctcatacccttcatatacatagctatcgatacgtaccccgataccattcggttccgttaattgccggataatacccggggaaggcatgaaattattttccgtatcctccgcacagatccggcactcgatggcatgtcctcgttggaaaagatcttcttgacgaagatgcaaaacctcattattggcgatacggatttgttcctttaccaaatccacccctaccacttcttccgtgataggatgctctacttgtagccgggtattcatttccaaaaaataaaaatggcggtccttatctacaaggaactctatcgttcccgctccggaataatgaaccgctttagccgcagccacagccttttcccccatttctttacgtaagtccgctgttaggaatggagacgggctttcctctactattttctggttacgacgttgaaccgaacattcccggtcaaatagatgaatgacattaccatggttatctcccaatatctggaattctatatgatgcggctcctctacgaatttctctatatataccgtatcatcaccaaatgaggacaacgattctgaacgagccgtatgataagcctcgacaacctcgcccttctcatgtatcaggcgcatcccttttcctccacctcccatagaagctttcagcataacagggaaaccaatttcttcgcaaacccgaagcgcttcttccgcactttgcaacggttgctccgtaccgggaaccacaggaacctctgcggcgatcatgcgtttgcgtgcggcgatcttatctcccatcgcttccatcgtctccgctgacggaccgataaatatcaatccttcttgcttacaacggcgtgcgaagtccgcgttctccgacaagaaaccataaccgggatgtatcgcatcggcatggtgccgtttcgccgcagcgatcagattgtctatattcaaataactttccttggaagccgccgggcctatcaaggctgcctcatccgcatacattacatgccgagcggtacgatcggtctccgaatatacggcaacagtgcgaatccccatctccttacatgagcgcatcacacggatagcgatctcacctcgattcgcaacaagcactttacggatcatgtcgccacgaggacataaattctccataaatcattaactattgattcttattcttttcgtactgctttcctaatccctcgagcaaaaacagcctttaatgaatggcgccaatttgcggattgatgccttggtacatgcttgtgccgtggagggggatatgcagatcgtgaagcggatgaaggagatcgttcctgagttcaagagccagcattctaaatatgaggtgttggatgaatagagcgaaataaaaagtaaattatggatttatccgtgagggcctatgctattaatgttgatttaaatatagcgtcaaaaaagaagagcctccccagaggcatttgcaagaaaagagaaggaaccatgtgggttttgtgatgaaaagataggatgatagagattttgtagaatcgatataaggtcaaggttttgtaccggtcttcttttcccgtaaagggatttagaaggccggttctgtttttatatatgtgtttgaaaatccgtatgtaagtacggtgtccggccatatgcggcgcagggataaacattccccctgcgttcgcatgatgaaaaagatctatgagcgtttgagagagagattggggcataagcccacggtgaagaattttgacgcgttcttggtaacgttggggccggatgagcgggagtcttggaaaatggatgtgtgtagtttgggatatggagattattataggaagatgcccggggcgtaccgtaaatttatccggaagtatatggagcatgaccgggagtgcgaacggtgttatatacgtaagtatacggtgcgtggtgatttgttgtattccccatttcgtccggaactcttgttggagctagtgaagcttgtggagtttacggatcgtgagactcccccttcctccttggaaatagcctcttgcttgttgatggggtttgattttccggactcggtgcgtagcttggcttctcatttgcgagaggcggggcattctgcggaagcagtcttggtgcttgccggaaagagggaggtgacggatgagttttaaaagagatatggatttgaatgttagttaagaatagcaggtttttgttgtctttgaaaaggggaattttggggcttttttatttttaattagttgaatattacttgtttgatggataaaactacggacgttcgtctcttctgggccatcttacctttgtgtcgtgctccataaggggtatataaccataaaaattaaaagatatggcacaaggttttaagttggtgttgcgtccgtcgaagccgggtgagaaggattcagagaaaaagttttatgcggtgtcgaaaacgaatggtacctctagtatgaaaacgctatgtaagttgatctcggcacgtagtacggtgtcgtcggcagatgtgaaggcggtattggataaccttaatttcgtattagatatggaacttcaggagggtcgtatcgtaaagttcggcgatttcgggagttttcggatctcggtgagtagtgatggtgtaacagataaaaaggatttcaattcgggtatgctgcgcccggcgcgtatcattttcactccgggaggtgagttgaaggatacgaagaagacactggagtactcacggatctcccaagatggtgccactgcggaggctggtggctctgatagtgatagcccgagtgagatttaacgtgcaactggtaatggccgtgctgctttgcgtggccggccttgccttagtattctgtggtttttgggtggctccttccggtgagatagataacagcgtgctggtcgcatttggggagatctgtacgtttgccggtgcgttgtttggggtggactactcttataaattgaaaattaaggattgaaaattgaaaatttgagttaagatggaaaaggatgagaagagattgacagagcattttcgtatggacgagtttgtttatagtgcgatggcggtggaacttggacttaataatgcgttaccttcggaggtaataccggcgatacggaatctaacggtacggttgttggaacctttgcgtatatatcatcgacagcctatgtatatcatgagtggctatcgaagcgaagagttaaaccgattgttgggaggtgcccctagctcgcaacatatgaagggggaggcggtagacatttacacggtggatcgcaaccgactattggaggacttggtggcaagctgcctgaattttgatcaggcgatcctttatcgtacgaagggattcatacatctttcattaaaaaaacatggggtgaacagaaaacagattttatttaaataggagggggtatgagtggattttggaaaaaaggatactatatattgtgttttatcgtacgtacattatataacttgttaagtcttgaaaaaaaacctaaaaaataatgcccgataaatttggattgtatgttttatagcattacttttgcacccgcattcgagagagaacggcgcttcaggccaatctgcggattgatgccttggtacatgcttgtgccgtggagggggatatgcggatcgtgaagcggatgaaggagattgttcctgagttcaagagccagcattctaaatacgaggttctggataaataaattgtagaaaaataaataagatgtaaaaagaaggtctctcattgcggggggcctttttttatgatataagcgttgtctttgggatagtatttcgtatttttgctcatagaagttacgaaaagagtgtaatttattggaaatgagcattgggtaatcgctcataatagtaataggttacgaattagttagttatctactgcattattcttctgtgcgttgcgtaaccttcaaagaactcttcgtatgcaaaagtaacaataaaacgggagatttagaaatgaatctcctgattttttcttctcacacaagtttttccgtaaaagcgattttatccgtcagcacaccatcgcccaaaaagattttgaacgaacgtgtgccgactgccgcataagcggagaaaagggctttgcctcacgcctaaacaatagtttagactgatgagacaaggcccctttcttttgtgcttatgccaaagaggtgcttttacggggttttgacgatttttcttttttcgttgtccttttgagccggaagcggaaagccgtgtatgaccgcacattccataaatggaacaagccgtcactcacggcagacaaaccgggaagaattattttatccatccgaccaaacacgtttggccaaacagataaaaacatacttccttgccgatggtttgcccggtttcacgctaccggctatgttcttttctgttggggatgtctttttcacggatttctcttttgaagttttcctgtctaatctgcctctacttccgtttacctccattttcgcgcctttcagtgagccgcatcaggcagtcattttcgtgctgggtgcaaaggtaactccgggattgtacgggaaagcaaggtcaagcctcctgttttctggaaaaatctccagcccttcgggtagtattttcccgaaaaaccttgcattccctaatccctacctttttaagcacccgaaacgaaaacgaccgatgcgacagaaagacgcattaaaaaaaatgtcggataaacgagaggcagataagatagtttgaaactcaactccctcagctcttgaatccgcattaaaaaacaaaaaatcaaaaacaaaacggatatgagaacggcaatagcaacaaaattcgtggcatgggaagtaccaagtttggagaacctgcaaggcagcaaggtgtacggacttcgcaccaaactgaacaatggtgagaaattgagccgagaggaaaaggattggcttacacgcaacgtgaacagcaacacctatttcaagagcgcagtacccttgcaaggttggatgtttgacttttccgacattctccgaacctacattgtaaagcagtatggacattgggcggaatacaaggctaccgacaagaccgcactccgcagtttcctatacggcaggatagacagcatcgtggaacttaacaaatgatacggctatgacagcaacggtaaatttcagacaaatggcgcaatacatagggcttgcgatatgcaccctaatcatgcgcaccgccttttgggtgtccggcatcctttggtacatcgtcagagagataataaacggagtgttccgagtggcaataggggtaatcgtggctattctttccgttatcctgttcttcggcttcattctttggttattcaccctttaatccctaccgacatggcaaagagaagaagcaagacagtggagcaacaatgcagatactacgaggtgggcaacatcttcgagtacatggtggaaacatacctcaacggcaatatgtccgtgttccgtggactctaccacgaactgaacaagaacgcacggaaggactttatagacttcctattgagcgaggttgagccgatttattggagggagattttgaaacatactatttgacaactcataaaaacgacagcgatatgaaaggaacagaccatttcaagagaacgatacagatgtatttggaacaacgcgcggaggaagacacgctctttgcgaagaactaccgcaatccagccaagaacattgacgattgcgtaacctacattctgaactatgtgcagaaaagcggttgtaacggcttcacggacggagagatatacggacaagcagtacactactatgacgagaacgagattgaggtgggcaagcctatccaatgccaagtggcggtgaaccacattgtggaactcacggcagaggaaaaagcagaagcacgtcagcaggcagtccgcagataccaagacgaggaactccgcaagttgcagaaccgcaccaagccgacaaaggcgaaaacagaaacccaagttcaaccctcattatttgattttggcttatgaaaccgagaaacaaatttgaaaaagcagttcttgcccaaagcaagaaactacgcccgataaccccgatacagataaattgggcattccgtaattgcgtggagcattatgcacaccgcttgccgaaaggtcgtaccacttgtatggattgcggtcatagttgggtaatgacggagcagaccgagcattgtacgtgtcccgaatgtggagcaagtttgaaagtctgcctcacctatcagcgcaaggtaagacaaaagcagtatttcacaacccttaccacaagcggagaataccaagtgctacgaatgttcttgcttgtcgtgggtatggagaaaggggttaatgccaagtcctatgcccttgaaatcgggcagtattggtggaatgaacaagggcgtaaggctgttgttgccattccacgcacattgggatgctacatcgacacgttctcattcgcttctccttttgctatccgcaatgacaatgaagcgtaccgccatatctcatattccccgatatatccaagatataaggtgttgccgacgctccgcagaaacggctttaacggcaatttccacgacattgtacccaccaaactaataccggcattattgtcggacagccgtgcggaaacgctgttgaaggcagggcaatatcccatgttgcgctactatctgtaccactctttcaatattggagagtattgggcttcaatcaagatatgtatccgcaacggctatactattgaggacggctcaatgtggcgtgacaccatagacctcctgcgtcatttcggcaaggacacaaacagcccgaaatacgtttgccctgccgacctcaaagttgaacacgacaagttggtggcaaagcgcaacctgcaaaggaaacatgagcggactgaacagcaacgcaggaaagcgattgaggacgagaaacaatatctgaaagctaagggcatattcttcggacttgcctttaccgacagccttatttgcgtcaaagtcatagagagcgtggaagaaatggcagaggaaggaaggacgatgcaccattgtgtgggcggttaccacaaacgaaaagactcccttatcctatccgccaccattgacggaaaacgaattgaaacgatagaggtgtcactaaaaacttttgaggtggtgcagtgtcgtggcgtatgcaacgagaactccgaataccacgaccgcatcatcgcccttgtgaacaagaacgccaaccttatccgccagcggatgaaagcggcataatatcgacatctaacaactaacattatggaagtaagatttgaaagcatggttttcctatgggatgataaaatccccacgatgttccttgaatttatgaacctcctcactctttgtcagagtgaggagcaattaagggcgagcgtcaaggactttgccgagaaacacgaacttgacaagttcttcctttacggcttcggttctcatcatttctacctgcaccaacgctacacgagcgaccccgaaatggtgatgcaacacagagtgctgtctgtacatttctaatcatctaaataacaacgactatggcaacaaaaatgacaattaacggagtaagcacctgccaatcggcaggaacggagaactacgagaaattccaaacgggtatcggcagacgcaaacgcacccttgtgcaatacgactaccgccacacggacggggaacttttctcttgtgtcaaacccacattagacgaatgtcgagccgcacgggacaagtggctaacggcaaaggaaaggaaggaggagaagcgatgaacgaagcaggctaccaaacgctgatagtcaaattcagcgaacccattacggcattggacggcatctttgacgatgccgaagcgtggggagttgataccctaaaggggtggatagacagctatgaaagcagccgtttcactgccattgacagccatacggcagtcatcacgagcgagtataacatggaatgtctgaaagagtggctggaaaaatgcacacccataaccgagaaaacagaattttgaacattggggcggtgtccgcaccgcccgaaccataaacctaaaagacaacggatatgatagcaaagacaattttagagcagattggcggcagacgctttgccgccatgacgggaagcaaagacttcacagacatgggcaacggcttgcgcatgagccttgcgaggaacaagaccagtgccaaccgccttgacatcatctatgacggaggggcagacctatacaatatgcgtttctaccgcaagacgttcagcaaaaagacattcgagagcaggacgaaggacattgaaacgcacgaggggatatattgcgatatgctggaggaaatgttcacgatggtaacgggactttacacccgcttttgaggggtgggcggcaaaagccgcctactttctttcatgagcatgatggcggataagaaagtaggcaaagaaacctttgtaccaatctacgatagtattcacaaaaacaagttttaatcatggaaacaagcagacagaacggaaaaaccatcttgtacagcaacgacggcataagcataaagatggttttcaagaaccttacgggcaggaattttcaaggtcaggaatatacagactatatccggcatatcgcaatcggcagcatgggattttcacccggtatcatagagcattgcagggacggtgaggttgcaggcaaagggacaatcccgaatgtatgaaaactgaaactccgatgaagttggcggcttcatcggagtttctttcgtcagacacttattctttatggtacatacagcagcgcaaactcagccttccttcgtttgagcagcatggcgtggcgtttccccttatagttacagaaagcgatatactcccggtagatgttcctgtcacccgcctccagctttcggattagcgtgcttttgggtatcttcccactccccaaaagacggtacggaccgacattgtaggcgagcgtggcaagcagaagcgaatccttcccgaactgctggaacatcgcgcagaacttccgcaagtcttttcgcagaagcgcgtccgcctgccgcttcgtcatggtgcgtgccgaatacctttcccccggctgcaaccgatgtccatatcctacatacgggtgatgtttttccgaatgccagccctcaaaatacttcgtgcatcgcaccgccctctcaaatggtggcagccggtagatagccgcctgcccgtccgttccctcatggcgtctgttccgtgcggacacggaacagaccgccagaagcgaacagaggatagccatgaatacacgcatcatcgtgtaaggggcttgaagttcccgatggggacaacagtgataaccccgtcatccttcacgtttcggttgttgaagtcaaattccaactcgtaggagttgctgaaattgtcctccactaccacgatgaagttgtgcgcttcctcacccgccgccgtgtagtacagccggaacttctcgttttcgagcaggtagcggtcattgggcaggaacgtgattccgttgtccattttcagcgtgccttccccctcgaactggaaataccggatggtgtagagggtgttggcgaagtcgcccgtctttttcagctcacagcggatttcaaccgtctgccccttcgtcaccttgttcggcacgggcatggtttccaccgtgaagggataggattgctgtatgtccatgtcgtcgtcacacgatacgagcgtgagcgacacggcagcgaacaggcagagtgccaacgtcttgaagattgatattctcttgtttttgttgttcagtatgttcattgtcatttgatttttaagttattgttcttttttggttgtcagttgcagatactcgttcaagtccttgcaaccgtcatagagagcggaacggtcatagacacgttctccataatgtcctttcagcgttttcaacgtgcgccgtccggctgcgtcatggtcgagataacagtctatgcacccgcagccgtccagatacctcattgccttttccacgttggcaacagagttcaatacgaggcactcacccttttccaatccgaacgtggcagcagaaagaaagtccatgaagccttcaaaaacgctgcacacgtcagccggagagccttccgccttgaccagcgacacatctttcggaggcacgcatcctttgaagaagcggctgcggatctcatatccacccgccacgttcggaaaaccgacggcaaaatatcgtttgccacgcacacagtaattcagtcggcagcagtagcgtgatgcgacaacgtaaggaatgccccgttccgccagatagtctgtcaatggagaacgaagcagagggacggcttccactccctcaaaggcaggttctgtctgcttcggaatgtaggtcggtttgtcaaactctgcaatctgcatattagaggttcccgctataaacttcacttgttccatgaagtcgccacttccgataaactccccggcaagcgtgaagatgtcaccacctttgcccagaccgaagtcgtaccagagctgtttcgccacgttcacacggaaagagggcgtgcgctcgcccctatacggggcgatataccacagctcgttaccgctccttctgacaggctcatgccccagccgtgcgagaaaaaccgcaatgggcatttgtctgatgatgtctatttccgtccgttccatgtccgtgtcagttgatgatgaacttgattccgaccccgaactgcgtatgaaacttcctcgtgtcgccaccccacaggcaacgctcccggaggttggcgagcagggcgatacggtctgccacgtaaaactccacatcgagcgtcagcgcaccgccgtagatgaaggcgtcccggtcatggagcgtggagccgtcatgcagtaccttttcgccccagttcaccgattcatatccggcaagagccgaagcacctgcatagacgaacacgattttacgggcatcggaaagtatcttgaagtcgtatccgccctccgccgtgaactgcgccacgggtatctttccgtccttgtaagggttgttcttcaacagatattcgccgccgaacacccatttgttcccctttttcgtgtaggtggagagagccgccccgaaactgtacccgccgtcgttgccgccgggattgaagcggtccgccatgttcgccctgacctcgatgccctgcatcttcggcaggcatcgctgggcgtgcgcttgccccgtaaacagggcaagcgacgcgatgattattgcgatgtactttctcatggtcagcgcacttgaagttcgttgatggtattggcacgtaccaagtcctcgttctcaatcacgaaagactggtgacgccccccgttcttctcgttgagttccaccatgaggcatttatcgtcggggatagtgaacttcgccatcgtgaacaccgtgcgctcgctcttcttgcccggcacgagtgtggcgtaattctgcgcacggagcggcaggatgatctgctcctgcacggcggtacgcttcgccaccttcttgtccacgattttccatgtgatgtagtccacatcgaaaggcacattgctctggttctttatctccgtgtggaaatagagcaaaccattatgcgtgtagatacctttcagcagatactggataccgaatcgcttgcagccgatgtgcttcacctcgcgcttgttctgcttgtggatggacttcatgataaggcgtaccagcatcgggctttcgctgcccagttccttcagatagatttcctgcgcattgttcgggcggttcaccttctcgccgtcatggatgaagtcgcacatctccacattgagcagcaacggttcggaggcatatttcacgttgaaggtatagaaactcccgtcctccgttatcacggacatattggtttcgttcgggaagttcctcacggtagccttcacgcggatgacgttctccgctccgtcggctttgcccgcaatcaggtcgggcgaacctaaatcgacgtagcgcacctccgaggggaaaatgacgtggacggtcttgtcgtaggtcacttccaagccgtgcgggggaaccatgcggtcgaaggtcagcttctttgtcagcccgtgatacagatcgccgtccgcctccttctgcggatagacctcctttgtcaaggtcggttgttcacttccgttgtccgttacaacggttacgttctcctgcgcgttggcagttacgatgcccatagcgagggcaaacatgatgattacttttttcattctactttggattttagtggtaaataaaaatttggttgttgtttttttagtcgttgattgttattgttttcaatctctgtcctgatatagcatgaccttgtatccggatttcagatgcaccttgacggtacgcatcttcttggcgatatactggcttgtgccttgtatcagccccttgcccaaatcggaggcaagctgcgcccctgcgttggtggagatattgatgctgctgcccagcgagccgcccatgttggcggcaacctccctgacggcattcatttccatcgagttgggaataaagataccggggtgcccgtccgtgtcatacaccgccagctccaccggaatgatagtgccgtcatattccaacgacgtgattcctatgtcaagccgttcgccctgaatctttgctgtgcctaccaccaccgcattgcgggggatgattttgtccgctacctccatcggctccagcagccggagtttgacagcttgcccgtcggtcacgctctgcgccccatagacacacgccgatatggtgttcttgtctgatacggtcgtgacgcccaccgccgtattgaaactgcggttacgctcctgcgagaaggaggcgacaaactcggcgttgctcatcggctgtgagagcgaggataccacctgatgcgtcacctgcctgacaggtgcagccgtgttctttccggctttctgcacggggtaaggctcagccgcctgtccgacaggtggctgtgtgccgttctgtccgcccatgtacttcgccgccaactcgtaggacttctccatgagtaccacttggtcatccacagcggacgccttgcctttctcgctttccagttccgattccagcgaagcgatgcgctccaacagttcgtccatatccgcgttgtcgttcttcggctgttcatagaagttgccgagcgtggcattgaggtcgcggtaggcggctgcggaggactggatggtcttcggggcggatttcacgttctcttccgttcctccgggattggcaaggtcgaagtccctgccgctgtccgtttccgccacctcgcggtcgaacatatcgcccagctcctgcatggcgcggttgcggttctcttgccgctcctccatcgccccctgctcgtaggctttcgccttgtcgccgatgatctggcggttcgccttgtcagcgtcgggcatttcgatgttgtaaccacccgtccccggttgctgttccttgtcggaagacggggcgaatatcagccacatagccccgatgaataccagcaccatagcgggcagcactatcattttctgacgtttcagcctttgggcttcggtcagcggcttgcgctccttcttcggtttcccattgtcgggagccgccttgttttcgtttttaggttcattcttcgtctgttccatataaataaggtattacgttgtgattgttttacggctttacggacagtcccacctgtccggcatggtctgttactatccggctgccgccattcctgccgatgtcatagacggctctgccgaaggtgtagatggcaagcaccgcgaaggcggcgagcatcgccagcacgatgcgcctgcgtgtcttcgggggcaaaccgtccagatagcctttgagccttgccaccagcattttctttttgttgtggagcttccagtacgcatgccaaaatgatttcctgattttcttcatgtccgttaccttttgatggtttgtaaatccttgttctcgataatggtgaatccctcaatggtgaaaccgttgggattgtcgtccgaacgggacgagttcaagaggcggcacgtggtcacgaggctgcgttcggtgacgttgctttgccggatgattttctgcgtggcataggtcacggcacggtagggatagccgttgaagtcgcacaccacgctgtccaccttcagcacttggttgatgttcccggagatgatgcggttgtagtaccccttctcggcaaagtccgaatagtagttgtacacgcttttgtccgccaatagcagggcgcgtttcacgttatgctctatcgcgctcttttcgggcgagagcgtgaagaatagctcgtggaagcggcgcacgtgttcccttgcctccgccggacggttctgcgacaagtcctgcgagagagccagcatcagcgacttgccgttgtccagcacgtaaatcttttcccgttgccgctccgcgaagcggtaggaactccacacgctccataccgttatcacggcgcacaacgagaggaagacgataccgaacaggcgtatctgcctgaacgatgattcgatgtttttgagtgacttaaattccattgttgtttattcgtttttaattgtcagttgattatttcagcagtttcccggcacgtccgaccacgtttcctgcggctgcacccgccacgctgcccgccatgcttccggctcgtcccgccgtctggttcacgttgcggccgtagcttcccatgcctccggcttggataatccagcctgccaccgttggaatggtgaagtagccgatgatgccgattatcatgaatatgatatacaccccgtcactcgaatccagcgagaagttcggatcagcctgcatccgttcgatgtcgctttgcagcatcagcacctgtatcttcgccagtatggtactgaacatatccgacacgggcagccacagatagacctgtatgtagcggcatatccactgcgtgagcgtgctttggaagccgtcccacaccgatatggcaaaggctatcggaccgagtatcgccagcaccacgaggaaaaacgtgcggatggtgtctatcacgagggcggcggcttggaacatcagttccagtatctcgcggaagaagtcgcggatgcccttcttcatgttgtacatcccacgctcgatgtgcatccccgccatcgtcaccatgtcgccgggcgaccagcccagttcttccagttgtttgtcaaactcctcatttgacacgaggtaggcggtttcgggattgcgcatcatcgcttcgtactccagtttgtccttctgctcacggtatcggttcatgtccagcgtttccgcctccagcatctttgccgtaccctgcacgacgggcgacatgatgctgtttatcgtacccagtaccaccgtcggaaagaacatgatgcacagaccgatagcgaacgggcggagcatagggaacacgtctatcggttcggctctcgccagcgactgccatacccggtaggccacataaaagagtgcgcccagcccggcgatgcctttcgccacgcccgccatgtccccgcatagcggcatcatctgttcgtagagcgagcgcagaatttggtgaaggttgtcgaaattcataggctaccagtatctttcgttcatgttcccgtacagccccatgatgcggtcaaggtcgtttttcttcttcgcacgcaggtaactcacgctaatgttcttgttggtgtagtagctcacgaggttgcggtaacgcttcatcttggagtagcagcgttccaccacgtccatgcgctccttgtccgtcatggagagcgtggtgatgttcaccacgtttttcaactccgtcagcacgtcgttggattcctccaacagcttggtgtagccgaaggcgatggctcccagttcctccaccgtgaagttgtcgtcacgcatcatcctctggaagctggtcacataggtgtcggtgatgtcacccaccatcaggatggtctgctgcaccttccgggcgtcttttaccagattgttcacggatttcagtgcgtcgtaatacttcttgccctgctcgtaaatcttcaccgtctcttgaaaattttttatcatgttctgggcggtcgtggaagtgtgtaccacgttcttggaagtgttcacgatgctctgcgcgatgttggacgggtctatcaccgcccactgtgcgcttgccctgccgactgcaaacaggcacaggcagataataagtgttattcttgttctcatgttactttggattttagtggttatcgttattgctcgtttatcggatggtccggtttcgggttcacgcgcacatagtccccgttgggcgagaaggtcaggatgtccgtcgcctcgttgtaggacacgtcgatacggaatccggtgttcatgaacaggttgccgttctcctcctgcaagagataggtttccggcttcagcttacggcggatgccgctccgcttgaacaccgtcaccttataggcttcgccctccttgtagataagcacgtcgggcttgccctccacgctttcccagttcccgcaaagcaggtcacggcggttgtccgctacatcgcaggattgcagcaccatgaccgccagcccgattaaacacttgctgacttgcagcattttcgttcttgatatactcatacgcattttcttttttagttgatgaatctgtttctatttattcctttctccgcctttcggcaagctgccggatggcggcttcgatgtcgccgcccaactgctccgccagacggtacacctctactttttccgtttcttcggtggtgtacgccagatactcttcagcactaacttcggtggcatagaccgccgactgcgtgccgcccagtcctatccacacttccttgtagagccttgacgggttgtttgccatgttgatggagagtatctgcgacttctccttctccgtcagccccaacagggactgtatggcatcaaacttgttcatgtacttccgctggtcgagaagtatcttgcagtcggagttattgatgatgctctccttgaccacgggcgaggaaatgatgtcatccacctcctgcgtcaccacgattgcctccccgtaatacttgcgcacggtcttgtacatatagcgcaggtactcagccatgttcgccgaagagagagccttccaagcctcttccactatcagctgtttgcgcacgcctttcagacggcgcatcttgttgatgaaggcttccatgatgatgatggtcacgaccgggaaaagctcgcgattttccttaatactgtcaatctcgaagacgatgaaccgcttgccgagcaggtcgatgttctccgtggagttgagcaggaagtcgtagcgtccgccccggtaatactgccgcatggtggtgagcatattgtcgatgttgaagtcggacttctccacctttatctcacgctctgccagtttgcggcggtagtcgtcacgcatatactcgtagaaggtattgaacgagggtacgatgctccggtcagccctgatgcgctcgacataggcgttcaccgcgctgcccagttcaccgctctccgtcttcgtcaccttgtcgtcctccgacttccagagcgtcaacagcagcgtcttgatgctgtcctttttctccacgtcgaacacgtaatcatcggtgtagaacgggttgaacgaaatcggtttctcctccgtgtaggtgaagtacacgccgtccgccccgtttgtcttgcgccggatcatctcgcacaagccctgataagagtttcccgtgtccaccaataccacgtgcgtaccctgctcgtaatattgcctcacgaggtggttcataaagaaggatttgccgctgcccgaaggacccaacacgaacttgttgcggttggtcgtgatgccccgcttcatcggcagatcgctgatgtcgaggtgcaacggttttcccgtaagcctgtccaccatcttgatgccgaagggcgataatgagctgcggtagttggtttcctccgtgaagagacacaccgcctgctcaatgaaggtgtggaaactctcttccgccgggaagtccgccgcgttgccgggcatcgccgcccagtagagcgtcgggcagtcgatagtgttgtggcgggggacgcactccatgctggcaagctggctgcctacgtcgttcttgatatgcttcagttcctccgcgtcatcgctccatgccatgacattgaagtgagcccgtaccgaggtcagcccgtaggaatgggcttcgttcaggtactggtctatccactcgcggttgatgctgttgctccggctgtatcgggagagcgactgcatattcctcgcggacttctcgaatttctgcaaattttcctcgctgttgtcgataatcacatactggttgtagatgtggttgcaggaaagcagcagccccacgggggaggcgaaggagaggcgacagtccgagcggtcggtggagagtttctcgtagcggatgtcggtagccacctttcctggcatatcctccgcgtcggagagggtgtgcaggcacaggcggttgtcaccgatacgcatttcttttgccgagaggtcgatgtcctgcaaggtcgtgtcgccttcgggcatgagcgagaagtaacgctctatcagcccggcggacttctccgtcccgacaatctcgtcggtggagaggcggcgcagcctcacaaagccgctgtcgttcatgatgcgctcgaactgttcggcggcctccatgaacttcccggcggtttccttgtccagctccttcgggatgatatgtccccggcacagcgtactgaagttgctctgcatacggttacgttctttcgtcgtcttggtcaagtagagatagcaggagtgtttcaggtacggacgctcgttgaagtggcgttcaaaggaacggctcaagaaactcatgtcgtccttctgtaactccggcatatatttctccttgatgaaccaatcctgcttatgcacgacgcagaagtacggtagcaccttgatagccttgcaccagcagccgtgtatcgcctcgtactctgcgcccgtcacggtgtaaagctccggcagttccacctcaaaagccaccgtgatgtcggcgtctttggagatgatgcagccatgctccaccgccagcagggggaacttgttttccagtgttgtcattttggatgtatttctcatgtcgtttcttcctttcgttgccgtttgagtaatcgggtgatccgccgtcggttgataaggtatcggggatggctccttgccgctcccaatttcatcagcccgtgttcgccgtaccgggcgttcagcgcgaaggtctgccatacgaggacggaagacgatgccgcgccgaagccgatacatatccactggtcgatgccgaccatatagaggatgacgaacaggacgaagagagccagcagacctccgcagaaaatgaagaggtactgagccttcaaacccttgaactcgaccggacggccgatacccttgtttatcgggtattcagccatacattgtttattaaaggaagaatgagcgcaggatagtggcggcgacaatcaagaagatacaagccccgaaccacgaggcggcggtcttcgaggtgtccgggtctccggacgagtcgagtaggtcagcccccttacgggagctttcccctctaagaaccgtacgtgcgagtttccccgcatacggctcaagcaacatgaccgttaccaactttgttgtcggtaaagtcacctcattttcgactttcatattcataatctactttgtattttacgtttacaactggtatgtacaagagcttttacctttcgtccgctgattatttgttcagtgatactccaaggtctttctttatcaatacgctctccgcatacaggacacaccttactctgtcgtttccaaatgtttatcaaagattgcctgcctttcagcgtttgcttcatgtggtaggtttctctccattcgtaatacgatttgtcggctgggtcgtaaggattggcataatgtcgaaccttaacgaacttttcatgatgaatggttggtagataggtcagttcaaggtaatcaatcttatctttcttgctcatatctgccgcaaatctccacgagcgtccgtgtagcgttctgaaatatttgtcctttacccaccctttacatttctgtggatgtctgcgtcttgcccattgccatattttcttgaagatttcccagtccattcgatggaatatctcacccgaagtaccatatttataatagtttccccaaccttttatgattggattcaacatcataatcagtgacttctgtttaacacacttgttggattctatcgtcttacggattttgtcacaaaatctcttttgtgcatcctttgacggtcttgtcagtaacgtgttgttacggaactttcggatattgaaaccgagaaagtcgaatccctcgcttatatgagtgattttggtcttttcatctgatagtgtcagacctctttccgcaaggaacttgtgtaccagtggaagtatgacttgctctatcgtttccttatcctttgccgtcacaatgaagtcgtctgcataccgtacaagatgtatcttggggtatatctgtttgtagttctttttatactttttgatacacttttccagtagttcttgcagtccgtcaagtgccatgtttgcgagtgtcggtgatattatgccgccttgtggagttccctcttccgtcgggaaaagttcaccgttgaacacgtagccactttcaagccatttgcgtagtatctccttatccatagggatattgttgattagccactcatggctgatatggtcaaagcatcctttgatgtctccttcgagaatccattcgggagctaccgagcgagaaagaacgatgtagcattgttcaatggcatcatgcgtacagcgatgtttacggaatccgtaagaatgactgtcaccagtagtttctgctattgggtcaagagccattaaatataatgcttgcatggcacggtctttcatcgttggtattccaagcgggcgtaatttcccgttcttctttttgatattcacacgttttagaggttgtggcttgtaaccacgtcttttcagagtgaatatggctttggctttcgccaatggcgaagaccatgtaaccttgtcaacgccggaagtagattttcctttgttagtcgtaactcgttttacagctaatgctttggcgtagaacgagtgggtaagcatccattgcaaggctttgaccttgttgtgtttgccttccctctgagcctttacaatacgtgcttgcagcttttggacaaaacactcgcatttgttccagtcgattttcgaccagagttcgtgaatgtctatgtctttaggcgcacacgccaatttctttgcgttcatttgctttcctttctttaaaagttctgtaaactatcttgtaaagtgtcaccataggcggaagtctgtccactttcgtgtcggatgatgttacccttatcagcccgtgatattggctcaatccgtatcctccccattacagggaggcattcgctttttccgctctcctatacccgcaccccatataggcttgccttacggcttgcttaccagttccgaaaaactggagagatacgggcttaccgtgttttacataagtgacaaataagcgggttaggtcctgtctattccaccggcagtgctaatgtccgtgtgtccccaaaattcaagaggacagccgactgcttaccttttggttcgagcctgtcaacagcctttggctcgttgtactttacgatgtttatcggacagttcgctttcgttgaccataccgctaagccaagctcctcgcgctgaatggtgttatcagccgttgattttccctcgcggttcaatcttctcctttcggaaaggctaccttgtcgggacagcttcgcacaaaagaattactccttatgcacgtgtccgtaggctactccagacggaactggaggtgtaatctcagtgttacacaatcacttacgcaacttcacgtcgcacgaattttccgtacactttcacgccaccgataagcccgactaccgcgccgatggcgtagattaatttcgtgccggggtcgaaatacgaactcaccatagaggtggcttcgttgatgccagccagaccgtttccctgtgcgaaagcggaggcggttgcggcaatcataagtgccgcagcgatgattaacttttgtctgatgttcttgttcataaactgttcttttttgtgccgtccaaagggtggatagtcctttttcgggcggttgatacttgattactttactttggttttagtggttgcccgtttgtttctacggacttggggctgtccgttgcgggttggctgtaccttgtaccgccgtgcgcgtgggtgtcgtcattttacgttttcatttccattcttttttagttgttatacatagtttcggaagtcgaactcctcgatgttgtcgggaatcacgaacaccttttccttttgttgtgtcacggtcatgttcaccgtgtccacgaaaactgccatcgcctttgcaagcctctcgctcattgcttcatcggtcaggcgttccgttattcttgtgaaaagctctgtcccgtccagttccgtcatgacctttccggcgtgtcgcatttcctcatcggatggtgattccttccgtatggtgtgtactgccatgtcaatatcctcgaagctacttcccgaagcctgctttttgtctggttcttcatcctccggttcatcttctccgtactccagttccgagggcgggatgctcgtgaaggtttcatcgagtttgtcctccggtacttgtgtcgggcgtgagacggtttccgtgtttccgtcgtcaaaagtagcttcttcctccgacagctcaatgcctttttccgaagtggcggcttcttgcgtcggtatggcagcggttgtccgggtcgatgccatcttgaaacggctcttgccaatgatgtccgaggtgtctgcgtgaggtatttccttatcctttccttgctctgccaccgtactgtccaatgaccgccacagcccggcaatatgtctgaagaaacggatgagcttcgtgtccatgatgcggtcatagaacagcagaaacagaaaccacacgttgcaagcaaccgatacgattaaaaacgcctttgtcataatcttactttttgggcgttttcaatctgttccatgtactgctgcccgtattgtcggaaatggtcgcggaggatgttatccacaaacttgccgatgctcaaaccgtttcccatccgactggtaacgatagcgactttctcatgaatttctcggctgatgtatatacattgccgcgttttgatttccgatgcttccaggaaagtcgagagcggtttgtctctgcctttatccttgcggaagtcaacgtcggtattttcctgcccgtagtcggttacacactttgctgcacggacagcggttctttcactctttcctgtttgcagatactcagcctgacggttcttatttgttcttttcatacttctttgttgtttttgagtgtttataaattataggattccatgtgccgtttgaacgattcggctatctcgtcttggaacagcgtgaaatggtgtgtcagcacgttgtcaagaaatgccgcgatagtcacttcgttgcctccgattacatgaagcatcttctgtatgcggtcgtggtactccttgcggatatagacctgcttgccgagccttgccgtgatattggaaccgcatatgaatactgtgtcataatccaatttttccggcttgctgttcctgcgcctgcgttccggctcctctttggagtgcgaggcgggtggagaaacggcttcttgtatcgcttctttcggaggtgggacaggagcgttcccgtccgtgcttctcgcttccggcggaatgcttgtatcgtccagtcgaaatgagttgattacggcttcgctgtcgatgtcctcgattcttgttttctttgccatgccgttcagtttttgatgatgccgagaatctcatcgacgagtttgtcgaggttgctgccgcgtaccagtattttgtccgccggaaacgccgtggagcggaataccgccttgcgttctgccgccgtctccttgcggaagcgcttactgtccggtagatgtgtttccagaatgggcagggcgaactcggcacagaccttgtcgtatgccttgtaaagttcagtcttttcgcgtccgtccaccatgttccacacgaggtaaatccctttgatgccggacttgcccgtgcttatcatctgttcgttgatgacagtggcgaacttgatggaactctccatcaccacacggtcggcgatgatgggcgtgaagatatagtccatttgggaaatggtctgcaccacatcggcattgttgattgttcccggcaggtcgaagaacacgaaatcgaggtcgggctgcgctgccaccagattttcggcggtctttaccgcatcttccgcacggctgcatctgatggtgtacgggttcttcttcagtcgtttgagctgctcatacgccagcaccttgtaatgcccgtcctccatgacggctttcatgtcacgcttgcgcatgtcatggatactgtactgcgggaaatcgcagtccaccacggctacgttgtagcctttcacatagtgcagatagcttgctacaagcactgtcagggttgtcttacccgctccacctttctgcgtggagattgccacataagttgcttctttcatttttttgataatttatttggttatacatctgtccggtggcggtagcgtattgtcattagtacgtacgcacgcactcccattcatttatttattcactccttaatccggctgtgcctgcgggtattcatcggtttgtccaaccgtccatgcttttatccgtccgcacggacgtgtgcttggaaaactatctgaatacatacacctgttttcaaccgtttggattgatgcccggattgctgtccgaacatctggcggaaggagtgtattttcagtcccacatccgaatcacactgcaaataaacaaggatattttggaacttgtatcacttctccggcaagtggcagcacgttgcgccggttggcactgattgtccgggtcaagcctctgtcggacatcgccttaagggcgtaactttgcacccgaacggcagggtacgccgcaggtggcgcagcccggagtttgaaaggaatcatccccaatccgtccccgacggatttttatgttcacctgaacatagcaagatgtcttttcagccgctcaaaatattttgagcagccacgaaaagcacttgcccttgcagggggcgggctttccctccgaagtcgggaagcctttcagaactgcggtgctgtaatccgaagcggcggcttatgccgtcaatccgctaaatccaaagtaatatgaaagagaaaaggaaaagcaaatcagggagaaatcccaaacttgatccggcggtgtaccggtacaccgtccgtttcaacgaggaggaacacaaccgtttcctcgccatgttcggaaaatcgggtgtctatgcacggtctgttttcctcaaagcgcacttcttcgggcaaccgttcaaggtgctgaaggtggacaagacgttggtggactattacaccaaactgtcggattttcatgcacaattccgtgccgtgggtacgaattacaaccaagtcgtgaaggaactgaggctgcatttttcagagaaaaaggcgatggcgttgctctacaaattagagcaacacaccgtcgaactcgtgaaactgagccgccggattgtggaactttcaagggaaatggaggcaaaatggtcgcaaaaatcagtgtaggaagttcgttgtacggcgcgattgcctacaacggggagaagattaacgaggcgcaggggcggcttctcaccaccaaccgcatctacaatgacggttcgggaacggtggacataggcaaggcgatggagggttttctcaccttcctgccaccgcagatgaagatcgagaagccggtggtgcatatctctctcaacccgcacccggaggatgtgctgaccgatattgagttgcagaatatcgcccgcgagtatctggaaaaactcggtttcggaaaccagccttatcttgtattcaagcacgaggacatcgaccgccaccacctgcacatcgtgacggtcaacgtggacgagaacgggaaaaggctcaaccgggattttctctaccgccgcagcgaccgtatccgcagggaactggaacagaagtacggattgcatccggcagaacgtaaaaatcagagattggataatccgttgcgcaaggtggccgcatcggcaggtgatgtgaagaagcaggtaggcaacaccgtgaaggctctgaatgggcagtaccgtttccagacgatgggcgaataccgtgcgctcctttccttatataatatgacggtggaggaagcgaggggcaacgtgcgcggacgggagtatcacgggctggtctattccgtcacggacgacaagggtaacaaggtgggcaacccgttcaaatcctcgcttttcgggaagtccgcaggctatgaagccgtacagaagaagtttgtccgttccaaatcggaaatcaaggataggaaactggcagacatgacgaaacgcaccgtcctttccgtgctgcaaggcacttatgacaaggacaaatttgtatcccaactcaaagagaagggcatcgacaccgtactgcgctacacagaggaagggcgcatctatggggctaccttcatcgaccaccgcacgggatgcgtgctgaacggttcgcgcatgggtaaggagctttcggcgaatgccttgcaggaacacttcaccctgccatacgccggacaaccgccgataccgctatccatccctgtggatgctgcggacaaggcacacgggcagaccgcctacgacagtgaagatatatcgggcggtatgggcttgctcactcccgaaggtccggcggtagatgccgaggaagaggctttcatccgggcgatgaagcgcaaaaagaagaaaaaacgcaagggcttgggtatgtaatcagagtatcaacaattaaaaaatcaatgtatgtcacaacaagaagacgatttgagggcattggcgaaaatcatggattttctgcgtgccgtgagtatcattttagtggtcatgaacgtgtactggttctgctacgaagccatccggctgtggggcgtgaacatcggcgtggtggacaaaatccttctgaacttcgaccgcacggcggggctgttccattccattctctacacgaagctgttttccgtccttttgcttgccttgtcctgtctgggtacgaagggtgtcaagggtgagaaaatcacttgggggagaatctggacagcatttgccgtcgggttcgtgctgtttttcctgaactggtggttgctgcccctgccgctgccgcttgaagcggtgacgggactgtatgtccttaccattggaacgggctatgtctgcctgttgatgggtggtctgtggatgagccgcctgttgaaacacaatttgatggaggatgttttcaacaacgagaacgagagtttcatgcaggaaacgaggcttatcgaaagcgagtattcggtcaatctgccgacacgtttctattacaggaaacgctggaacaacggttggatcaatgtagttaatcccttccgtgcgtccatcgtgttgggtacgccgggcagcggcaagtcctatgccgtggtaaacaattttatcaagcaacagattgaaaagggctttagtcaatacatctacgatttcaagtatcccgacctatctactattgcctacaaccatttgctgaaccacccggacggctacaaggtaaagccgaagttctatgtgatcaacttcgacgacccgcgacgctctcatcggtgcaatcccattcacccggattttatggaagatattacggatgcctatgagagtgcctacacaataatgctcaacctcaataaaacgtgggtgcaaaagcagggcgacttcttcgtggagtcacctatcattctgtttgccagtattatctggtatctcaaaatctatcagaacgggaagttttgcacgtttccccatgctatcgagtttctgaaccgccgttacgaggatatatttccgatactgacctcttatccggagctggagaactacctttcgccgttcatggatgcgtggcttggaggggctgcggagcagctcatgggtcagatagcgtcggcaaaaatcccgctttcgaggatgatttcaccgcagctctactgggtgatgtcagacagcgagtttacgctggacatcaacaatcccgaagagccgaaaatcctctgcgtgggtaacaatcccgaccgtcagaatatctacggtgcggcactcggtctgtataattcccgtatcgtgaagctcatcaacaagaaggggatgctgaagtcatcggtcatcatcgacgagttgcccacaatatacttcaaagggttggacaatcttatagctaccgcccgaagcaacaaggttgccgtgtgtctgggctttcaggatttcagccagttagtgcgtgactacggggacaaagaggcgaaagtggtgatgaacactgtcggcaatattttctccggtcaggtggtgggggaaacagccaagacgctctccgagcggttcggtaaggtgttgcagaaacggcagtccatctccatcaaccggcaggatgtttccacctccatcaacacgcagatggacgcgctcattccaccgagtaagatttccgggcttacgcagggaatgtttgtcggttctgtatccgacaacttcaacgagcgtatcgagcagaagatttttcattgcgagattgtggtggatgccgaaaaggtgaaacgggaagaaagtgcctacaagaaaattcccgtcattacaaacttcacggacgaggacggcaacgaccgcatgaaggaaacggtgcaggcgaactaccggcgcatcaaggaagaggtgaagcagattgtgcaggaggaactggagcgtatcaaaaacgatccggtgctgtgtaaactgctaccagataatgagactgtctaacaagtccccaaaattgaaaattatccctatcgaagtttgaagtgacccccaaaagttggatacaatttttttggggggcacttcagttctgacgggtaaaatcgtaaaattcggacttgttagacaaatacttacgcggtttcaacctcaggtactgaatctatcgaattgacaaatttaaccaattgcggatctgaatctttttgtatgaggtttcggagactctttttcaattcataagcatcatcccctgctgtatttattaaatccatataaaaatctttgttttgcagaatcaatgaacggcatgccccatcggaaattacaggtttcactattttatcaataacgtctccagcttgacttttcaaattaccatgcgatctaagccatgtttcgaaaaattgaaactttattgcattgatagtctttttaccgatgcagaaatcatttcttatatcggtaactgtcgatttaatttttcgtttatccaatctttcaactatattcttgaaacaattagggaaaggattcaaactttgagttccagaagcaatatccatcagaatctttttgccaaattcagtcaagttatctggcaaggatttgattttagccagtaaatgttttattgcgacaaaccaataatatgatgtatgtgctgttctttgggcgtataatgtatcaacacttatttcagacaacgcttcgaacgctattttattgatatgatcggtcaggacattgcttattttagtggtcaaatcgtaaaaagatgcgtcaggaattacatctttaatattgttcttagtgatatacttatccaaatcggtattccactctgctaaatgctcgataaatacctcatccgttacacctattctgttcttaatatcttcaaattggggcaatatgtctgagagcaataatttatagccaagtttatgatttaccatgtattgtagtgtttcatttaatagcggtatattccatcccacactatttactaataagtctccatgatccacataatagtccatgagttctgcaacatattttatatctccaccctctattaaggaaacggaatgaccatgtgccaattgcatggcgactaaatcgtaatatccagactctttaatgtttcggccatcagtttctaattcagaatgcaactgatttatgtaggttgaatctaacgttacaggtaaaggtctttcttcgtcagatgccaataaacgataggttgtaaatatagcccctatattatctttatttacattctgttcatcaatgcaattcgtgatcgcttgcaaaagcgttggaaacgtataggtagaattatcttttaacgtttttacaatatctgcatggtcgaaattatcgggtagtaagtttgccaaataattatcgagcgcctccgaatttgttgctacttgataatatttatatgctttagttgtcgcgttatcccgataggcagcatctgttgcatttgcagcttgaatataatcgataaatgtatttggcttgactgtttttgcttcaatcaatgacgtaaaatcgcacgccaacttattttgcgcaataaacctgtctattgcatctaacgttttgaaatagtcgccgccattgaagtcattgaaccgaactatcttcttatataattgagcaatcacatggttttggctttccgtgtctaaatgcaacagcagttcttggtattcgacagggaacacctgcttctctatggattcttttaatttcaattgtgctattctttgccatacacgcagaataacatcgctctttcgagttaatttatgcaaacaatgtataatcttatcgataagcgcattgtccatacattgtataacttcttctaatacagtgtcaaattgtttattagtctctgcatattgatttatgtcgtggtcttcttctccgttgatgcagccttcaatatattttttcaatggaatttgtcgagcatcttcaacatcgacaccatataccaaagctgcaatttcgcgttgtgtttgcagatcattgttaattattgtttgaatgccattcagatagtcgccggacaatatttgttctactggatttgccagaatatccgtcttcttcaaacagaacaatgctatgtttatcatcaaaatttcgttacaccactcttgtttaagagcgaccatctcattgatatatgatataatttccctaacattggcattaggatttaccaatctgaatatccgatttatagtttctttcgcttcattttctgtttctccaaatgcttcaacaaacagtttgttgaatatacttcgatagtcggtaataacaggaggagcaacacgataaacaatagggaaagttttattgataaaatacttggtcagttgtttcgtttgttcgtcggtctcatctccgaatgcacaagctaaatgtgtttcatcgaaaggaataacagcccaaacattttcaaaaccgctatcggcgaagaacgtatggatagaagaccataattcttttactttttcagcggggagacgatccatgttgtcaaaaacaaggactaatttacgttgtcctttttccttgataaaatcagaaatgtcttgcatccatgttttgaactcgtaaaccgttggttcgtcttcgctcaaagtctcatagcaaacgtccttttcgactttatcttgataaatagctaacatataactccatccatatttatgatctttgctatatgcccatttccaaacgcacaatgcaataagaactggcagtgcagctatgataatagacaataaagaaaaccaccatgttgtgggtgtaggttttactgcatacgcaataaatgtaaatatcggagttaaaactgcaaccaaaaatgccgcaaccataccattactgataaggggatatttttcggttacggtctccgttttacgggctaataaatatttcagcttttcagaccatgatacggttttcgtacctccacctttgacttttattgttgcatttccagataggataccatcatcaataagtttgcttgtaagcaattccaatatagagcggcgttgcaagtcctcttgatgtccccatgcgtcatactcaaaaaagtaatagtcgtctgataattcacgttccaacattttaaccacgttggattttccagatccccaaataccttcgatgccgataattcgaggtaaagtacattcctcatccaatgaatcattctgacaaaaatggcgagcaatagtttttgccaacctttcttgcgaacctccatcgaatttgtcaataccacacggtttattttggataaaccgcggatattgctgtttggattgtagttttgtttccatatacgtaatttattgattatacgaactccaaataattctcccgatttaccacatgaaactcggcatagggataggcttcttggaaggctttcggtgcggccggcattttatttccccacttgaactccaaggcggtaagactgtcggcactctcctcaatcaggtcgatttcctgtttgtcgtaggtgcgccagaaatagaactccctgtgcagtccctcattgaagttcgctttgcgccgctctccgatgatgtagttctcccacagcgcaccgacatcctgccgaatggccagcggtgagaaagccccgataatggcattgcgaatgccgttgtcgtagaagtaccacttgccagcttttgtaacctccttgcgtaggttacgcgaataagcccccagacgatagataacgaagaccttttccaataggtcgaggtatttttcaacggtcgtcttgctcatgccgagttgtttacctaactcttcgtaagaaacttcgctgcccaactgaaaagctatcaatcgcagtagatcgcgcatcttgctcgaattttttaagccgtcaattgctaagatatctttaagcaggtatgcaccgacaatatcacgtaggtagtctgttttacgttcatagttctccatcattactacttcgggataggaaccgtaaatcaagcgcgcttcgaggttctggcgggtttcaagtgccgtttccgtctgtgcgatttcccgttgcgagaatggtgtaaggagaaattgcgtactgcggccgaccaacggttcaccagtcttattcagcaaatcgaatgacgaagaaccacttgccaagacacttattcccggtatttcatcaactatcaacttcagaatactaccgatttgtggtatgttctgtgcctcatcaatagccagcaaatcaataccatccaataaatgccgataattggctattgagcgattctccaatagtgctaatgtgtcgtagtcttcgccgttgagcatcatcgtcctacctgaatagttgtccacaattttacgcatcattaccgttttaccaacacggcgagcaccaaaaatcagtactgctttattgggcgcgattcgtgctgtaatcttctcttgaagtattctatttactgtttccataccttataaaatataatgcaaagataatcatatttttttaattggcgaattttacaaaaaaaacgggctattaaatggcgatttttacaaccacaatcttatggaagttgtttcattgtttttagtaatgatatatgttcatactatgatgactcaataatttaccagacatacgtttctgaaatttgtccttataggaatgaaaaactcacatatattgtgctaattaatatataattaaatgaaaataaaaagacaggatacgagtattcctgtcttctcatatgtaatggatatttttttattttctcatccgctccaactcctcatcacgcaacattctctcgttcagtttttcctgcatcctgtcaatgaaataggtgcggctttcgttcttccggcgtttgatatcagtgtagaagcggtagcagtctttagaatcaaccccgaatatcttatagagaagtggggcgagctgtttgagcggcatattgccgttgttgatgcagcccatcacgtctatgccgtagataagttccacgaggtcgatggcattgcccgtccattgaagaaggctggcggtggtttctgttgcgttgttggcggatattagtggtggcacttggggcgtggcaaggaatttctgcatctttcttacgaaagacagagccttgctgacgtaggcggcaatctctcttttttcttctgacagattacgtacgggatggtgctgcaactcgatttcgatgtaggcaagcgcgatgacggtaaggttcatgtccatgccgccgttgcacagttcgatcacttgggtggcgaaagccgtgtatgccgtttccatattgcagtcgccggcttcgtttatcaggcggaaaaagtcggtttccgccagcaagaaataattcatggttctgtcaattttgaaaattacactttgttttctgcgtgcgcacatgaatataattggcaaaaaacgcggcagaaaataaaaaatccaacactcaattttacaaagtgctggatttcagaggtataaaattcagtattttttcacaaggacaaattatctccgacttaaattgtttgtaatcggaacatttattctattcctgaaaatagaaatgtatgcttgccgcacattttggctatcttgcttttttatcaaggatatagataatgcgacatacaccgttgggatagcttttcaaagaggaaagcgtccagtgttgctctggcagagccgacttaaaaaaatgtcgtccgcttccggatatgaaaggaacggtgtatagtatgatttcatccacagcgtgcatccgcagcagtccgtttatatagtctgccgtgtccggtgtggcttccgcgaggtaacggatgtttgtgcagtcttttctccattcgtgcagcattgaaatggaatagtccggtgtcacacggtaaaaggctttcttcctgatttcatcaagaccgcaacggtcaaggcacaaatcctgatgtgctttatcatataactctgaagaaagacatccgtccatcgtcagtacggcgagaatctgaactttacccataatcgtttcctttcgttaggcaagggtaaaaaagtagcgtgcaattcacactaccttcaagcgatggctctggtaaagcctttacggagagtacgtgaatgcacgctatgcgtaagcatagcataagcatcacgcaatcgtctccgtagttccaatttaccagattttcgcttgaaacgccttgcggtcttatcctatatgttggcggcgaaaagctcctgccaatcgccgtttttctcaaatgttatgcaaagatagccaaattcagtgaattacgggctatgattgcttgaatttatatttaagtccatactcttcaagtttgctgtatagtgttgtcctgcctatgccgagcagttctgcggcgacactccggttgccgtttgcctgtttcaacgcacgcaatatccgctccttatcctccgcgtcattgcgcaaggcgaagctgacagtagaggtcggtttcgtcacggcaagttccagatgctctttcatgacaacaccttcctgcgcctgcaatacagcacccataactttctgccgaagttcccgcacgttgcccggccatgcgtgtgtcagcaacgctttacgtgcttcggaactgaacccgctcacgctacactccagctctctgtttgccatatcacggaagaactctgccagcggcataatgtcttcttgacagtcacgcaacggaggaacggttatcccgaagtcgtgcaggcggtacagaagatcctgccgaaaacgcttttcattcaccgatacctccaaatcttcattggtagcagcgatgatgcggacattgaaattccggtctgccttgtctccgaccgggcgataccgcctctcctgtatggcacggagcaacatctgttgggtttccaacgcgaggtttcctacctcgtccagaaacaacgtgccgccttccgcctcatggaaatatcctttcttggcattgtccgcacctgtaaatgcacctttgacgtgtccgaagaaagccgacggtgcaagctctttggagagtgaaccgcagtccaccgccacaaatggcttgcctgcacgtttgctcttgtcatgcaacaggtgggcaatatgctccttgcccgtgccgttctcaccaaatatcatcacgctcatatcggtggcggctaccagccttatgcggtgcatgattttctgaaaggcggaaccttcacgggcgaatataggcatacggcgttgtcctgcctgacgttctttcagtatggaacggatcagggggacaagtttatcctccacaagctgtttgggaatatagtctatcgagccgagtttcatgctttccacggcggtattaacttcggcgtagtcggtcataatgatgaagggctgcatctttccctcctttcgcatccagcacaaaaggtctatgccactgccgtcaggcagacgcaggtcggcaaccacgatatcattatctgttgcctgttgcagatgtttcttcgcggttgagaggtggtaagccttcatattgcggtagccctcccgtgacagcatattgcagacatattcgcaatacacgatgttgtcttccaccacaattatttttgtcttattcatcttcgtattttctcctttcctcttctgccaaccgtattatttccactcccttatccagcacggcagtcacggcatggcttaacgcttcaccatccgggagagcatcgccacgaagcaatccgtaaagtacattcagcggttggtcggcacggagcacctcccacgaactgcgcaggtggtggatcagggaatccagcttttgcaggtctttttcttttgctgcatcccgtaccgcctgcatttccttttctgtttcagttatcaacttttccagcatgacggcttcattgccataggacaataaggcggaaaagtccggtttcccgtccggtgtcgcttttatggcacacctgtcggaaacctccatcagttccgatatggagaacggtttgaacaggcatccggcaaagccttttgccaatagttcccctttgttacaactgcccgaagcggttgccacaaccaccgggattgttggtgaattgcccacgttggacgaacgcaacagttccagcaattcgaaaccgtttatatcgggcatattcaagtctgtcagcaacaggctgtattctttctggcgtatcatttccatcagtgccgcagcatcggtgcaagtgtcgcagtgtattccttcttgggaatacatctctttcagcatcagaagtaatacctcatcattgtcaatggcgacaacatcatggaatttattgttatgataaacaggtgtattgcttgtatatccaagctgttcttcagcttcctgcatagaaatttcaactgtgaaacgactgcctttccctttcttgctgtctaaacggattgttccgccaagcatcgacacaatattacgcattatggcaagcccaagcccgaaaccctcctttgcggcggcatttgatagacgttcaaacgcaccgaacgcttgtttctgttcctcttctgtcatgcctgtacctgtatcttcaacgaccagtgtcagaactccattatcatattcagtaatcaaagaaacaccgccttcttctgtgaacttgacagcgtttgacagcaggttattcccgatttgtattattcgctctttgtcggtcaatacaatggcatcgtgtccagtcttcacggacaaggacagccctttgttcacggcaacaggcatgaactccgtttcaagtgtgtgcgtgattgctgaaatccggcagggtgacagacggggctgttccttgccgttgtccaggcggaagaagtcaagcaaagtgttaagcatatcccgcatacggtcggaggattgcagtatgttttggatatactgcccggacttatcctcacactgttctttccgtatcagtccggcatagcctgttattgctgtcagcggtgtgcgcagttcatgggtgatagtatgtaccgccttcttccttgacgttatcagtgcctcgttccgttgtacggattgttccagttgccttatcaaatcagttgtcttgtgcttgtattgtttaatgctttttgcatcacgatgtatgatgatgtaggaaattaacaacaatagaagaacgaatcccattaaaccgcctacttgcataaatgacttttcacgcatggcaactatttcgttttcccggctttgcagttcggtttgtaccttttcttctatttggcaaatcaattcttgcagttgtctgttaagttctgcattacgagctgcaaggctgtcggcttgttccgacaattggcgatcctgcactttctgttcgctgattacgtttctattgaccgaatgaaggatagtggttgatactgctggagttacttccttttttttgccgaatatgcctaagaaaccttttcgttttggctttttggactgttcctgcacacttttctgtacaataaccggaatttgattggctatcttcttgttaatagattgttgttcatccattaaccggactatctggaacatctgtcgttccttatcctctaaaagactgcgcacactatcgatgcgctctgctggataggtggccttgaaacggcagagcatactgtccattgccatacgccgtgcatggtaatgctcgatatctttatcgttccattccagtattgtttcacccaatagagaaaattttatcatttgaatattgatattgtttatttcttttcggagctcgtctatttttttattgccaagttctaatgcttctatctcctgccattcatagaggctattatatgccatacatccgataagaatggagataagtatatatcccaaccgtattgccttatagaaatttcctgaccgctccattattttaatgacattgatttttggaacatgaataaaagtttatctttttcgttcatgcggatattatcagaataaccgtcttttgttatttgatacccacatggcttaaccataaaaatgcctaagcccttagtgtacgaacttacttctgaggcatagtctttacttgtatttaatggaactttccctttaatatgacaccactcattattacaactgatgtcttcaatctcagacatcagtttttgcaaatctgtaatagctttggaactcgctacttggggtatctgcaactcaaaacagagcatcggttcgagaatgtccacacctgactgttgcaaagccagcctgaagacataaggggtcagctgtctgaaatcagcaggtgtacttaccgggctataatactcggcttgagtaaaagttactttcagatctgtcacttcccatccatgtaaaccagattggcaagacatacgaatcccttcaaaaacggcattttgaaaagaatggttcagataaccataggagatgtcactttcgatttgcaaccctgcccctaacggtaagggttcaagagtcagccctattgtggcccagtaagggttgggtggtacttcgatctgaataatcttattgaccttttttataggtcgttctttgtagatagtcttgatctcatcaaaatggacctttacggaaaatcgttcttccagcaatgtctgtatgatttccttttgggtcaaaccatataacgagatttccaattcatcactatatgagtttatggaaaaggacaaagacgggtcttcaatccacaatgtattcagagcggatatcaccttgcttctctcttcgggcttatttggccggacggaggatttgagagcgggatgctgatgagataatccttgaatcaaacaaggtttagcacctaaataatctccgattcgaaaatcttctatatcttctacaatcgcgatatcattggcacccacttcatcaacatttatctctctgccctgataaatagtctttagatttttaatcttgatgaatttttccgaatcgttgattcttacaacgtctcgaagtctcagacttccgtcaattattttaagaaaacttcttttatgccctttggggtcatgctctatcttatagagataagctgaaagtctgtttgagactgatgccggaggaagtataaaagaagaaatggcgtccaacaactcattgataccgatattgaacattgctgatccatgtagcaccggatagactttggcttttgccacaagagcgattatcgtattccaataatcagccggtgaaatttcgctatccgccaaatatcgttctaatatatcgtcgtcatggttgcatacaaattctttgtattcttcctttatatatgtttgggagcaaaccggataaaccgatccatcgacaacagtttgcataaacaggacatcttgcgacagatttgtttttatatccatatacaaacgctccaaattcacaccggcacggtcaatcttattgataaatataattgtcgggatttgcagcttttgtaaagtactgaacagcaactttgtctgcgcttgtatgccttcctttgcggataagatgaggactgctccatcaagcattttgaatgtccgctccacttccgcaataaaatccatgtgtcccggagtgtcaatgatattgcatttcactccattccagataatagatgtcgtagaagcccggacagtaattcctctacgtttctctatatccatagagtccgttatggtgtcaccattatccacacggccgcacttttccgttgctccactggcaaacagcagattctcggttacggaagtttttcctgcatcaatgtgagcaagaattcctaaatttataatattcatttggattaagcaataatatactacagtagatgcattgtcgaaacgcaccttttaatacctcctcgtagcatatgagaactacaggattactaactcgtattaatatgtatattattactgccgcataacgattacaaaattacacaaaaaaatatatctaacaaaagtgggaggattttttaactttttaccatagacattttattagggaagcgtaggttcaactggcaagtacaaataagtagaaatgtttgaacaacaccgttttaggaagttgaaaaatcaagtttctctctcggtatagcgtttattttggccaatatcttctttagtttagcatttgtgtatttcccattcgtgttctatttagctccttattatgagtatgtagcaagttacttatcaaattcagcctctttgagggtcaaatatggttttgcaaatggtgactgacaagacataaacaaggtcagcaggaattttttacataaatggacatgaatgtatataacctaaaataagaataaattttaataagggctgcccaaaaagaaaaaaatgcagttgccatcctatagatacttgcagaaaggataaaatttacttttagaccttttgggatagcccttattaatacttcagataaaattccttaggttatattttcaatcctttggaccgggtttcctccttggcatacagtcccggacgcccgattatgacatggttggcaacgatactatccgccggactgcgtatctgcggcggtgcattttcgggatattgcgcctgcctgttcctcacatcttccgcttccggcttgagctgttgcccttcattctccttttctgcgacttcgggcgtgggtggcgcaagctccagctgaatttttcggtcaagggcggcaagttcggacttcaactgcttcagctcgtcctccttcttccacaccttacccgctatctcctgtaactgcggtatctccatctccagcacctcgttcttcgccttgtactggtcgatgatggagggtatcctctccatcgcgttgaggaagttgcgggcggcggccaacgggtcagccatcgccagatgcccgttgttgtaggtgtacttgtagttcccctcgaccacgaagcggttgtcggtgaactccaatccctctttgagtatcctttcgctcaccacctttatcggaaaaccgtaaagttcaccgacctgcgtgtacaaccctccggtcgtggcattcttggctatctcctgcaaacgctttccgatgaccttctcatcggcggaatccactccgtccacctttattatattaaggcggttgccctccttgtcggtctgcaccaccgacaggaagcggttccagtcctccgtcatggcatctatgaaagccgtgttgttgcgcaactcgccggtctttgactccagcttgaactccgaatcacgcttgcccttgttgaacgacttgcgttccccttcgagcgatgcgatccgcttttccagtttcgccttgtccaacaggtcggtattgccggagagcaacgccatgtattccgagaaattcatgcccgatttttcgtccattgccccctcgtcgatggtacgcgcacccatcgcaccgcttttgagctggcttatgaaagtctgcttgcagtgcaggaggttgaacttgtagctgtccagtgacttctccaccgcgtagatgattacatccacgttgttcccggcgaaatgtttggcaatctcattacctgccctaactccgcgtccgtcacgctgttgcaagtcggacggtcgccacggcgtatcgagatgatggatagccacacaccgtttctgggcgttcacacccgttccgagcatagaggtagagccgaacagcacacgcaccgtcccggcgttcatggcgtctatcaccgccttccgcgccttgtcggtcttgcactcctgaatgaagcgcacctcgcttggcggtataccgtagtcctccgtcagtttgcgcttgatttccgaatagacgttccacccgtcgcccggctggtatgtccccaaatcagagaaaacgaactgcgtgcctttctgggcgtcgtatttttgataatactccgcgatcatcttggcacagtgactcgctttgttgtcgggatgatcttcgtaattcgggtctatcatgcgcatgtcgagtgccattttccgggcatagtccgtggcgatgagcatcttcgccttttcttccgtttccgaaagcggcagcctgcccaacaaggtggcatcgcccgtcttggcgaactgcatcagtttctgtatgaagtcctcctgttccggcgtgggcggtatatggtgcagtatctcgttcttggcaggacggtcaacgcccacatcctccgccgtgcggtagtccgtgatttcattatagaaggcggcaagctccggcactttgatgaagtagcggaaacgctccttctggaccacattgttcgtcacgttaaattcaaaatccgtcgtcttcttggcaaatatcgccgcccaagcgtcgaaacaccttatgtcctgccgttccagctccttcgggcgcaggtacttgaacagcaggtacaattcagtcagtgagttgctgatagtcgtgccggagaggaaggtcgcacccaagtcttttcctgtgcgctcctgtatggtgcgtatggcaaagagcatgttaagtgccttctggcttccctcgctgtttcccaatcccgccacacggtcgtggcgcgtgttgaaagtcagattcttgaactggtggctctcatctatgaagatgtggtcgatgcccatctgcttgaaatccaccacgtcgtccgtgcgtgactttatggcgtgttccaccttctccagcttcgcttcaaggttgtgcttgcgcttctccaatcctttcagcatcgcccgcgacacgttctttccctgctgccgtagcacttcgaggttttcctccaccgtgtcaagctctgcttgcaggatgcgctgctgcaattccggcgactgcggtatcttgccgaactggtcgtgcgacatgatgacgcaatcgtagtcgttgttctttatattattgaagaagcgcacacggttggcggtcgaaaagtccttctccgaagcgtacagaatacgtgcgttgggatatgccgcctgataggtggctgcaatctccgcaacgttggctttcagcccgataatcatcggcttgtgtgccaaattcagacgcttcatctcatgcgcggcgatgcacattatcagcgtcttaccggttcccacctcgtggtcgcaaattccgccgccgttctgtttcaacatccagacgcaatccatctgtgagggatagacgctcttgataccccggcttgccagccctttcaggttgaggtcgggaaaggtctgatgggagccgtcgtagcgcgggcgcacgaaacagttgaacttgcggttatacatcgtcacaagccgctccttgaactgcggcgactgctcttcgagccattcggagaagccgtttcgtatctcgtcaatcttggcgttggcgagttgtattccctcgctgtcgcgcatcttgatgtcgttgccatgctcgtccttgccgatggacttcatcatgtcagggcaggtgttgtgcagggcgtgttttaggaggtgcataccgtcatagttccggtaataccccttcaccagaaactcgtccgtgattttcatggtgcggtagccgcacaccaccgaaaactcgtccatgcttgcggaataggcgattttcacctccgtgtcgaacagccggctcatgtaggcggcatagacacccgtcggaatccagcgttccccgaaattgaagtccagatcctcgaaggcgatgcgctgcggctcggcatctttcagagcctccaacgcctgcttcacctccggcatacgctcattttcgggattgtcacccatccatgcctctatgcgttccgctttctctatgacatttccggcgatgaaacggtctttgatttcgtaaccggtcacgagcggattgtagtagatgcgcccttgcagggcagtgagcaaatcctccgccgtgctgtcggttatctcccgcatatagtcgagattgaccgtaccatatttgttgagcgacgcagacagggcttcttcgggagagcctacgttggcatggctctccaccgcgaaggaaacaggatgctcgaagatgtccgccttgacgaactttccgttttccatccgttccagcgaaaggatgtcgcgcccgcccgcatccatcatcactaacttcacgttctgcttggcgttgaggttgccgtagcgcatgacaaactcatcgtaacaggtattcagatgctctcgccacggaacatttgcctcgcgccggagcgattcataacggtacagacgctcgtaggcgtcacgcagcgacacatacaacaacgccttttccttctggtatcctttcaggtcgagcggctggaatgtcgccccgtatggcgtgatgtctttcaggtagccgatgttatgacgcccccggtcagccaccagcgacccttcgcgcaggtgcatctccggcgtgcggtggtaggcacgcggagaaaggtccacgacttcctccttcggcttttccgcttcgatgtcggggaaaaggaaagtccccaccgcttccgatggggtatctgtaacggcaggtgcggcgactgcctccggctgtgtttcctcctgtcgtggctgctcacgggaagtttccggcacggctttcacttccgtcttttccgccacttgtttctcgttatgctgccttgccagttcccgaagttctttcctacgctccggcgtcaaacccatcatcatttcatagaaaccgttgatgggaggattggtatcccagtccagtgtggcatagatgtcgtccgggtcggcaggcttggcggtgttctccgctttcacctccttattctccattgcgggttttgcagttggagctgtcggtgtaaccgtgactttcggtttgggcggagtggactttgccgtaactgcctttttcaccgtctttttctttttggaggttttcggttggctgacctcttccgtcatcccccagaggtcaagcagggtgagctgcacgcctgcggaatattgcgggcgcggttctatctccggcttttcatctgcgggttgcggcttttctgtcggagtttccaccgtctgcgccgaggatactgtttccaattttatggcaggacgctctactttattttgaacggcaactttttcttccgttcctgcctgccggattgaacccgaatacaagcgcatggcaagcctgtaatggaaatcctcgtcgagcatacggcgcaaatccccggcgatgcctgctgccttgccctcgtgcagataaaccatagcgggcttcccgtaggggtctgtgtcaagtttcgccatcgtatgcacgatgcgttccgggtggtggatgaaataggcgttgtcggtcagggcggttttcgtgtccgtctgtatcacggtcatcagccgctcgtcctgcgacatttccttcttgctgaggttcttttgcaggacaatcaggtcactgcccacctccgtgcccgcgttgtccgtgaacaggttgttgggcaggcgtatcgcggataccagattggcctgactgaacagctcgttacgcacggaggtcttggtgctattcaataccccttgcgaggtgatgaacgccacgataccgccgtcacgcacggcatccagtcctttgagaaagaaatagttgtggatggttttctgggcggagcgtctgccgaaagagtcgctccgctgaaactccgcgtcgaacacggcaatgtcaccgaacggaatgttggacaccgccaagtcgaaataattgttgaacggtctttcgattttctcaaaaccgcaggtgcgcattttctggtcgggatagagatgcctcaagattgtacccgtgagcagatccttctcgaaagccatcacatccgcattggggctgtgccgcagcatggaatccacgaacacgccgacacctgccgacggttcgagcatacgggcggggcggacgctgtaatctgccagcacgtccgcgatggtgtcggttatctctttgggggtgtagaaagcggtcagcacggacgctttcagcgaatccacaaaccgcttgtactctgtttcgtccttgctgttctcacggataagcctgtgcagctccaccgtcggggcgaacagttcgaggtcggatttcgcccaccggacggcatccgtcagttcctttgcagggttgaggatacatttcagaccgccgaaaccgcagtacctttgaagtatggcacgctcttcggttgtcgctgtcctattttccctgtcaaggatgaatgccgtccgtatcgcctcgatgttgtcccgcagtttctgtttgcggttaaacgccatattcgtctaagtaaaggacggttgctcccgtcagctccgtgtagagcaggtcgtaatcggaagacagggcgaaattgtcatccgagaggtcatagacggagaacacgttgccgacaagcggcagcagtttcaggacaaaggcttcacgcttctcttccggcacttcatcggcaaactcgttttccacgacttcgcggaggatggcgtaacgggaataatgcagcccgcgcagcagcgtgtccatcgccagttcctgcgcaccatcggcgggatagccttcaagccgtgccctctcatacgtttcggcggcacggtcggcccgttcccgtatgaaagcggtgtcgtcagcctgttcaaacttgttcgtgcggagatagtccagcaggtacagaccgtaataggaaaagtcggtctgaccctcgtttttcttcttgttgttcattactttggatttagcggattgataattaacgggataatcggttggaaaaaggaagaaaaaggcactcggtatccctccgagtgccaccactaaatccaaagtatgagtgtaatccggtatcgaagaacaattcattactctgaacaagtggcaaagttaatactatttcttccgtcctgaaaatttcttgtcctttttagcctccgggaacacaaaagtcgtgttatattccccgtcaaaggcgacaacagcatcgaaactcttgccctgtttgctcttgaaccctttgagcagcttggtatgcccttcggtgagcaggtctttgatttcatcgtcggacagggtgcgtcccgctttcagccggaacacgggcagtccgcactccgtgttgtcgcagcgtaccaccttgccgtagaaccgcatcctgcccgtgccacacttgggacacgcgcagccggagtcacggctgccgaagagcttgtcgcacgagatcagttcggaggttatctcacgtgtgtacgcctctatctccttgcggaaggtgtcgtcggacagttccccgcgctcgatacgcgccagctccttttcccattcgcccgtcatggcaacatcggcgatgcgcatcgtcttgacgacggaattgagggcaagtcctttttcggtgggaacaagcgacttcttgcagcgttccatgtaaccgcgcttgaaaagcgtttcgatgatggaggcgcgtgtggcgggagtaccgatgccacagtccttcatcgcctgccgcagtgcgtcgtcctcaatttccttgcccgccgtttccattgccgagagcagggtggcttcggtatgcagcggcttgggtttggtctttccttcggtaatggacgagcctttcggtgtcagcgtgtcgccttcctgccagccggggatggtaatttcctctttttcctcgccatagacggcacgccatccggtttgcttcacgacgctgccttttacggtaaactccactccggcacattccgccgtgacagtggtcacatccttgacgcatttctcagagaatgcctcgaccatgcgcccggcaatcatctgatagatggtattgtcctctttggagaggaagagcggttcgtcagcgtcagccttgaccttttggttacttttgggtcaagccaaaagtgacatgttagatctcatcaggcgactccgaatccccacccccagcagccggcttcttcgagatatccacggtagtctccccagccttctccgcacggagtaccgcttgctgagccttgcgggtagccacgggctggaactccagcccggcgaagacattcttcaagtcctcgcccggtatatactggatactaaccccggtgatgtttgtagatgtgaatttctcaagactctccgcaccctcgttgaggatatggagccggaatttacccagttcgccgaaatccacctgtttcccctcttggagggcatcgagcaggttctcgacagtggagatcaataccgccaccacatccgcccggctgacggtggtttgcatggatacccggcggctcagctgcttgagcgatagctcaccattgatctgtgccgtggcgtacgctttcgccggctcgtctttcttgatagggttggtccgaagggacacgctgtaatttaaagccatagatttgataattaaaaattgataattgaaaattgaaaatgaaatcgatttgttttcgataacgaatgtacgacattcggtttcctctgaaatgaataccgctgacagcggatgaataagggagataaaagaggagatatgctgaaaaataaacatccgtatagttgttcgtgtcgtatgttttaagtatctttataccaataagataaatcttaaaaatgcgaacgatatgcgaacaggatatacacaaatcgacgagtggcccgtgcggccctattccaagcgggagctggccatggcctacgcccccgagatcagtcccgtctcggccctgaaccggctggcggaatggatgcggtataacgatcgtctgacccgggagcttggtgatacgggctaccgcccgaggcaacgggtcttcacctccctgcaagtggagctgatcttccgttatttgggtcgtccttgagaggagacaccgccacccgtcggtataggcgagcggcgatgccggtactggcatcagacaacgccagtactggcgtagggctgcgacggtagtgcttacgggcaatgacagtagtggcatttccttcattccttcattccttcgggtgtctctcacgcacacacacgtgcgaggagaaagcgtactcgccccgtgcggtcttgatcagtgttcccttctccagcatccgtttgagggaggagtcgagtgttttctcgggtatgccgttcttcgctgcctcctccacggcctgccgacggcagaacatcattgggagggcattgaataaagcctgttcaggagaggtctggacagggatggcctcggaggtaggcaggaagcccagcacgtagctcgaatggcggtaaagaggctctatgagcgtgagtacggcttggaaatcctcgtcggtgacccgcaggtccagcttggggacgataccatccttgatattctcgatgggtatctccggggcgggggagagaccgggggaattgaaaatggaaaattgagaattgaaaattttttgttggggagggaggaatttctccaaggctctcaacagggctactatactcaggatccggcaggtattgatggcgatacgggccacggcgcttcgcatggaacctccataggcgtaaccggcgtgggagaataactgggcgaaccgttggttgaacagctctttctgtttctcggatagccttagctggatcgtttggaccgatccgttgatcaggtccagtacctgtttccattgtgttccccatgtggcgaagcgtaggccgtaatcctcgccttccgaatcgaattggtccatccactcatcgatgggtggcatgaaatagaataactggcgagagaacaggccgttctccgccgaggggatcagcggctttacttgcgccggggttccacttagcaatacgctgagataagactcatcgcattcccggtactcatgattggtacgccggttgaaggccagtcgctcatggtcgtggcatttacgcaaggtatcgctccaatggccgtgatccgctccgatggcggtactcacggtatcagcctcggtctcgcagatcagccccacgccgtcggcctctatgaggttctctaagataccggtacccgagttatcgccggctatgaggaacatcttgaggggcggttgttccggctcgggcgtctcggagcgtttcttgccgagtgagtcccatcggttcttttcctcccgataattctttaggctgtctttgtagcgggccatcatctcctcgtgaataggttcagctaggcgcctgacccatgtcaaggctccttttccggaggcgggaggcgctacgatgaaggtttgtaggcatggatacatgtatttttgtccgtataacacccgtacccgcttgttcaaggtgcccccgagtacggtgaatactcccagcaggagtatgtcacgctgggcgatggagtttccgcaatcgatcatctgcttgatgaacgggggccacggataatccgggaaagcgggtggcaagtcctcacgtgcgtacgtatgtgcgtgtgtgggtgtgagaggggcttgaaggtttgaaggattcttgttctccctcgggtattggcggaaggtgtcggccagttgcttgtccgtttttacgccggcaatctcggcccagtggaagacggagcctaatccgttgcgtccgttgcccgccttgagggcgtggtcgtatagcttgtccgcttcttcgtagaggtatttctcggacaggcggcagatgcgatgaaagaacgtccttcccgcttccccgcaatcgttggcggtggcgaaggcgatcggcatatactcttggtaagtgggagcgatgttcgccccttggtgttcgatggcggcgacaagccgctctaaatctgataatggattcatttgatttataagttataatttatgatttaaactgtcaactgtcatttgtcaacaatcaactctcccgcagcttagcggagggatcatggcagaggaaacacgcccgtgagagatcggcgtttgaggcatccgcattcaatccgtatttccatttcaggtattcccatgccgatagccgtgccttatcaaaagattcctctatggaagccttgggtgagagccggtaggggacgagcagtttcacgcctgtggtgcttgggctgacgaaagctaggtccggtctcagtttattatcggcgaacaaggtgtctcgccagtggagggtttcctccggcgaggggagatggtcgatatcgatgacaaactctccggaaaggaataacaggcggtcttccttgcgataggagaagaccccggccggtgtgacgtatggcagtaagttttgcttcagtttgcggaaccgtttctcgtcgctcaaagcgtcctgtacgctgagcgttcgttctttcagccactcgttggaggtgatataggtatgcaactgtttgacactggtcacgccgctcggcacttgattggagacgggggcgttgaaaaaggacatgatacattctttcattaactcgtttgatttaaagtttaggctggtaaaggaaaggtaaaagagtgagaaaaaacggtccggtaagttatttgcacctatcggtaagttatttgcgcataaaagtaattcggtgacaggaaaaagaagaagatatgagtgaagagaaagcgagcccgtgtgtgctgcacatccatggcgagaacatacaggtgctgcccaacgccatgtttgccattcaatatatttgcttggacccgggagaaaagccggaggtcgtttcggaaaaagacgtgaggccggatccggagccgtgtgatttattagcctcctatatccaagacgaggaggtgcgtcacgacttcgtaaagcgaatcgcccaatgcccggatgtggccaccctctgccaaacggtgctgaccgaccttttcaacgaggtcttttgcgactgcgtggaaccggccaaacttatcaagagcaaggaattcatcaacgccatcatccccctgctccccttcaagcaaggcaagagcttgcgcaatatccggcgggcgatcgtgaagtatgtgctgggggaggggtagagggactgcatattttgatatttagaggagaatcgtttactatcaaggagaaaatggatttatttgcctaataaagaaaatgagttatgaaagcgatgattgccctgatatgaatataccgaatatggatacttattgaagtattcttaagaatttgagtttggatatgaagcttgagttaatatcccggctttctaaatcattgttaagcaaggatcagtccatagagataattgggcctcgcaatttgccggggagtggaaagattcccgttccgctgagtcgatcatagaggatatccgaaattcacgaatctcaaatagcgaaatagaactgtgatgtgaagaaataccttttggatacgagtatttgtgtttttctgttccgtcgtaaatatggaatcgtatcaaagagaaccttgatttgatagatcgatttattaggttgataaacattgtaccttttacagactccatcgagttctacgctcaagaaaagaatcgccttcgttcgttgggtgtatccatagaggattttgatttgctcataggttcagcagcctgtagcggcaacttgatcctagttacagataatgtaaagcattttgcgaatataaagggattggctattgagaattgggtaaagcgatagtcttcattaagcagactggaactcataagatgcacaataatgccatcgaacgaatgttccgacacatagccattggtcgccgtaactggttgcacagtggcagccattttgccgcatcgaatatagggtttatgtattcactccttgaaagctgcaaacttacctttgtaccaagtgaaaaaataaatgtcatagagtttatgagaacggacgtattaaatcgaataaaagagaccttgcgtaaggttgtaccggctggaggacatgctttttttgtatggctcgcaggctagggacgaggcacgtccagattcggattgggatatattgatcttgttggacaagctaaaaatcgaggcggaggattatgacaatgtatcttatccgttagtggaactaggttggtcgttaaacgagtgcgtcagcccggtgctttacaccttgaaagattggatgagataccatttctccccctttgtacacaacgtaaaagacgaggggatacgattgctatgagtttgagtgcggaagatataacagcggttgtcgcttatcgtaaagagaaggcgcatgctaccttgattttgagcgtgaggatgtattgcctttgttggaacccacacgtaaattgttagccaaactcgagagcttgatcgtctaccaataatattgtaaattcgtactttactatttgtattatgctgagcgatttgtcttggtaatttatcacgataaatatagtttaaactcattttaaataaagacactcgttttttgtcctgtggtttgtcggcgggatggaagtgttttgtgtactaccttttatggcaataaatcaacttaaagcgggagcttttttatcttatatttctattgggctgaacaatatagtcggcttgctttatactccatatatgttacggatgttggggcaaaatgagtatggcttgtattctctagtagcatccgtagtcgcttatctgacgatattggatttaggtttcgcaaacgcgattgttcgttataccgctaaatttagggctgatgggaaggttaaggaacaatatgagatgtttggaatgtttcttgtcctttattcttttattgggattgttgctttttccataggattaggaatctatgccaatgtagaccacttgtttgatatgtctatgacagcggaggatttggagaagatccgtgtgatgatgctgttgatgtgttttaatttggcttttacttttccgatgagtatttggggagccgttatcaccgcttatgagaattttgtttttcagaaattggtcaatatagttcgtatagtgttgaatcccctagtgatggtagtattgctaagcgtagggtataaagctgttgcaatggtggttgttactactttgttcaatgtgctgacattaagcgtgaatgcttggtattgtttttataggattaggatcaaggtttgtttcggacattttcgttggggattcttgcgggaaatatcagtttattcgttttggatttttttggattctatcgtttctcatttttatagcagcgtaggacagatcgtgttgggtatttacagaggtgcgacaacagtggcgatttatgcgctggccattcagttgaagtctctgtttacttctttctcgacggcattaaacagtgttctgttgcccaaagttactgcgttggctgcacgagaagggacggaaaatgagatctctgatttgtttattcgggtggggcgtttgcaatattttgtgatgtcatttatacttgttggttttatcatttttgggaaggaattcattatactttggggaggagaagattatgtacaaacttattacattactctaatcataatgataccatttttctttgatttgattagtaatgtgggaattgtagtgttgcaggcgaaagataaattaaaatacaggtctgctcctatgattatgatttcattaataggtttgatgttgacttttccatttgccaattattttggaatctatggatgtgcatgtgcaatatctatctcaatttttgtgtcgaatgttttagtttctaactttgttttttataaaatagctgaaattgatgttgttatgtattggaaacaggtgatgaggatgtctttgtttcccttgtttgtaattgcgttttgtttttgtttgaaattttatatttctattatttctgtgtttgatttgtgtgtcagcatattggcgttctctgcgatttatgtattgataaattttattataaatatgaatgatcaagaaaagagtcaagtttttggtttgattcgtaaggttaatataaaattgttttaaatatgtccaaacatgcgtttttaattatggctcataatgagtacgatattttaaataaattgttattgctccttgatgatgaacgtaatgatatatttatccattatgataaaaaaagcaaattacccccccccattgagttaaaatatttaaatatacatgtgtttaagaaggtggatgtaggctggggagaggatagtcagatagaatgtgaaatgttcttgttcaatgaggcttataaaaaggggccgtttgattactatcatttgttatcgggggttgatctccctttgaaatcgaatgattatatccatgatttttttgatcaaaacaagggaaaagagtttgttggaataatggatgagcaatcttgttttatatgctataaaagggtctgttactattatttctttgtacgctacgagagacgcaagtgggggcgttttatcgtttggctgaataaaatctctgttaaatttcaaaaaatggtaggaattaataggaataaggatgtgatttgttttgctatacctattgtgcggatgagatgtttattcaaacattactgtataattctggatttaaggactgtttatatattcccaaagaagcaggggaacataatatgtgtgtgcgtgaaattgattgggatcggggcaatccatatatctgggataatggagattttgaatatttgaaaaagtctaataatatattcgctaggaaatttaattcgggtaaatcagagattgtagataaaatatatgactacattaaagaaagtaataacagaagaaagtaattataaccctaaattgtcggtaatagtacctgtttataaagttgagaaatatttggtacgctgtatagatagtatattggcgcaaacttttgtggattttgagctactgttaattgatgatgggagtccagataaatctggtgatatatgcgatgaatacgcttgtaaagacactcgtatacgtgtttttcataaagaaaatggtggcgtatcgagtgctcgtaacctaggattggagaatgttagaggtaatattctcacgtttattgatgcggatgattggattgatgtggattgctttgagaatggcgtttgtattatggacagggatgaccttgatattttacaatattcttataaaatgatccgtgaacaagatggttgcgtgattagtgtgcgcaattatgaatgtgttcccttgggatggagagagtttgtccggacagaccattatatcgtgtgtgtgggggggaattttattcgatcttcaattgtcaaaacctatcgattacgttttgatgaggctcttcatctggcagaagatcagctttttattatgagggtgatgagtttatctacccgcattgctcagacaaaagaaatttattataactattttcagaatttggctagtgctactcataattcttgtgaggaggatatggtaaagtcttcaagggctttgcttgaattcggaaaacgcaatcgattgtttaagccacaggttgataggatgatcactaatttttatgtcgagttgttacttcttaacaatgggcaagcaggtatcctcgattctgtttatcgtgaagcgaaagttgaaattagaaatttgaatatgaactctttacggattttatgcttctcatccttcttgggaatgagaatggccggtaaaatagtacttgcttatttaaagataaaaaagttttgtatgttgagttaatttttaattgtttgaatgatgtacaagagcttttttgtcaataatagtgatagagatagaaaaatcaaatatctgctttttttcttttggccttttggtgcctttatttattcgttaagaaatattcagtcaaaaagttctcgggtaatcttcttcttgatttgtatagcttttggcttgtgtattgaatgtaagaatgaagagttggatatgagtcgcattgcggataatttcctttcgtataaaaatatgagttttgtagagttgaaaggaataataatggattctataaatggagttggatttagagatttatacgaacatattttatattggtgtgtgaatcagatttcgtccaatgaacatgtgttttggatgatagcttcgatgatctatgcgtttttttatttaaaatcactgtcttttattcttgatgataagcgttttaaatcctgctttatgggatttatgatagtactaatgtttacaatgcctcaacctatattttcggtgacaggtttaagattttggacagcaggatggcttgctattttttgttccttgcaaatatttattcacaataattataagtatttcttgatattgctattgacccctttcattcatgtaacatactggatttatgtgtttttagtaacactaacttttgtcgctagattgagtgaaaaactgcttgtgataatattttttctgtcttatcctttttcttatttgtcgatgtcttttgtctcagatgtgattggaatggatatacttcctacatccttagagagggtcgctctgtcttatatgggcgaggatcatatagaggagtttaatcgacaaggaacaggttggttttgggtgtctgaaatgtttgatataattctgaatacttattatttagtgatgacttgttggattataaagcacaagtatatgatattagagagacaggacagatatttgcttgctttcatattagtagtgtattcatttgctaattttacactggttgttccgcatttaggaattcgttatctaggttttgttgaaatcttattaccgttgttatggtttagagtttttggattatataaatataagtcgtttatatatatgtatttaattgtcgcatctttttatttgctgtggaaacgtcttgtaatgcattattcgaatgtcttagattttgattttttgtatgatagttctattgttatgttaattgataaattgttatattaaatatatgaatatattacaaatacatatggcattgagatgtgggggaatagaagctgttgtagtggggctttctaatgagatggtaaagagacataaggtgtctttttgctccatttatgaacctcgtgaggaagatatcttttttcatcgtttagatagtcgtgtattaacttgttccactcataaaaaatcgcctggagtaaatttgaaatatttatggaaagtttatcgtgtaatagtaaaaggtaattatgatgtagtaaacatgcatggttatttatattattatctgatagcgatctgtttattacacaataagactagattcttttacacggttcattctgatgcaaggatggagaatgggcgttgggataggaaactttttaaactgaagcgttatttttttaaaaagggatggattaaacctattacgatttcaaaagagtctcaaagatcttttactgatctttatggagtacctagtaatttgatttataatggtacttcaaagccgagtgtcaagcctttttctatggataaatatcgtattacatcgaatacgaaaatcttatttcatcctgggcgaataacagaagcaaaaaatcaacagatgctttgtaatgtatgctatcgattacaacaggagggatatgatatcgtgttgttattagctggagagaaacaaaaagagacgatatatacagatttacaaagatattttagtgataggataaagtatttaggagagagaaatgatgtgcttgatctcttaagtgcaagtgatattttttgcctgtcttcgatttgggagggaatgcctatgtctttattggaatctttgtcggttggatgcatccctgtatgtactccggttggaggtattccagaagctgtgacagatggggtaaatggttttttatctagaacatgtaatgaagaggattattatatagcattgaaaagatcattggaaattgatgatgaaaccattcatcgtatgagacaaaagtgtatggagacatttaaacaatttgatatctttcatacatcgttactgtatgaaagatattatttagaataaaagaattgatatctttatatatggtgaaatagaaatatcttgtaaatttccaacagcgtaatttgcgtattattaattacaattcgatgtgatttttgtaaattaattttattctactataaataatttcttttatttttgttaatagtgaatttataaatatatatgaaagtattagtagttgtgactgactatccaaatttgcaaggaggtttggctttggcttatgtgcgaacaaggaatgtctattataaagaacgtggtatggaggttgaagtacttaatttttcagcaaatgaagattatagtattgatggtattcatgtcttttgcttgaaaaattttgataaaataataaatgaaaataagtatgatttacttatttgtcatgctcctaatattagaaatcactatttttttattgaaaaatatgattgttactttaaaaagatcatccttttctttcatgggcatgaagtgttgaaggttaataaggtttattctgtgccttatccgtttgtaaaacgtaataaattgttagagaatgttcgggatttgtatgatgaatgcaaattttttgtatggcgtagatatatagagaaaaattataagaaattagcatttgtttttgtgagtagatggatgaaggaggagtttctctattgggtgcacccaagtataaagtgtttggagggtcgtaactttgtaacatacaattgtgttgggagtatgtttgagaaaggagaatatgatgtttcttctcaaaagcaatatgattttgtgacaattagggctaatttggatggatcgaaatattgtgtggatattgtaaatgaattagcaaaacggaatcctgatttgagttttttgttaataggaaaaggtgaattttttaaatactatgaaaaagcagataatctgacatggttggattgtagattgaatcatgaagaaatgatagcaatacttaattctgctaaatgtgcattgatgccaacccggactgacgcacaaggggttatgatgtgtgaaatggttgcttttgggatgccgttgatcacttcggatatacctgtatgtcatgaggtttttgataatgttgatggagtgggttttatttcaaatgaagaactagattcgttttgtttgaaagatatatatgaaaatataaaaaaaagtgcaggtaaaagtgataggtactttatgaagaatacaggagaacatgaagtgataattttatcaaatttgtgtatcaatgttaataaatgacttaggaaatttgttctctatcaagaaatgaaatagaaaattgaggagaatatttgcaaacatttctttcggttttctagccttgttgcatattaccagaactatacttctttttattcttatcggtctgaatcttgaaatgaccgaatctcgaaaataacacataatcatattaacacatatttcttatgaaagcatgtttcatggggttgggctatattggcctgcccacggctattattgccgcaaagcacggggtggagatcgccggcgtggatatcaacgctcaggtggtggaggttaccaaccaagggaaattgcatatcatcgagccgggtatggaggagatgttgcgggaggtactggcctccggacatttcaaggcttacaccgagcctcaggtgagcgacgcttatttcatggtggtacccactcctttcaagggggatcatgagccggacgtatcgttcgtggagtcggctacccgtatggtgcttcctttgttgaaagagggggatttgtacgtgatcgagtctacatcgccggtgggaacgaccgagcggatggctagtttgattttctccgaacggccggaactggagggcaagatctatatcgcttattgtccggagcgggtgcttccgggtaacgtgatctatgagttagtgcataacgaccgggtcatcggcggcatggacgaggtctctacccgtaaggcgatggagttctacggccagttcgtgaagggtacgcttcacccaacgaatagcaagacggccgagatgtgtaaattgaccgagaactcaagccgggacgtacagatcgctttcgccaatgagctgtcgtttatctgcgataaagcgggaatcaatgtgtgggagctgatcgatttggcgaacaggcatccccgtgtgaatatcttacagccgggttgtggagttggcggtcattgcatagcggtagacccttacttcatcacggcggagtttccgatggagagccgtatgatctcgacggctcgtgagacgaataattacaaggcattttggtgtgcggagaaagtgaagaacgccatgctgcggtttgagttgaagcatgggcgtaagccggcggtggcaatgatgggcttggctttcaagcctgatatcgatgacttgcgcgagtctccggccaagggaataacgacgaaggtgttgcaatcgtgcaacaatgctgacatcatggtggtggagccgaacgtttcggagcataagttgtttaagttgactccttataaggaggcatacgagaaggcggatatagaggttttcttggtgaatcatagggagtttgcggggttgaattatcgggatgacgtggaggtgctggacttttgcgggacattcaagaaataatcgttcgttaaatagaagaatacgttgtaatgaggaaaataatgttagtcttcgggacccgtcccgaggcgatcaagatggctccgctggtgaaggagttccagaaacatccggagtcgttcgagaccatcgtgtgcgttaccggacagcatcgggagatgttggatcaagtgttaaaattgttcgagatcacgccggattatgatttgaatatcatgaggcagggtcaggacttatatgacgtgaccgcccgtgtccttaccggtatgcgtgacgtgttgcgtgaggcgacacccgatgtcgtgctggtgcatggggataccaccacgagcacggcggccgccttggccgctttctaccaacagatacctgtaggtcatatagaggccggccttcgtacccacaatatctatagcccgtggccggaggagatgaaccggcagattacggggcgtatcgccacgtataatttcgcacccacgcggttgagcaagcaaaacttgatgcgagaggacgtgaatccggactcaatcttggttaccggcaatacggtgatagacgccttacggcaagtggtgcgtaagataaagacggacgctgagttggacaaggagctggaaggcgtgcttttacgctccgggtatgatgtgaaccgtctggttgagggtaagagactggtgttgatcacgggtcatcgccgggagaacttcggtgatggattcatccatatgtgtaccgctatcaaggacttgacccggaagtatccgaaggtggattttgtctatcctatgcacttgaatcccaatgtgcgcaagccgattcatgaggtattcggtgaggatctttctcatttggagaatatgttcttcattgagccattggaatatctgtcgtttgtctatctgatggagaaatcaacgatagtgctgaccgatagcggcggtatccaagaggaggctcccggattgggcaagcccgtgttggtgatgcgtgatacgaccgagcgtccggaggctctcgcagcaggtacggtgaaactggtcggtacggactatgacaagatcgtgagcgaggtctcggcgttgcttgatgatacggcttattacgatgcgatgagcaaggcggtcaatccctatggcgatggattggcttgcggaaggatcgtggaatttttgaaccggaaggaatgagggtcttgatcgtttctccctcttatcttccagagatcggtgcggcaccctcacgcattacgaacatggcggagggactgtctggcttagggataaaggtggatgtgttgacttgcttacccaattatcccaagggacgtatctttgatggatataggggggctttttccaagacagaggatgtaaacgggataacggtcttcaggtactggacgtatgcctcgatctcgaggagaccgttggtccgtcttgccagtatgtgcgctttcgccacgaccctttggtgtttcgctctcaagcgtaagcgtataaaatcttatgataaggtgatcatccagacccctcctgttttggcggcggcctcggccatgttgctttttcgttgttgctaccggaaaaaggtggtactgaacgtctcagacctttggccattgtcggccgtggagctgggggccatgaaagaggggggcgtttatcatggggtgatggggcgtatcgagcgtttcctttatcgtaaggccacggcctgtcaagggcagagtaaggagatcgtggattatataaaacggtatgagccgggcaaggcctcgttcttgtatcggaatttgcagcatcgttttgttttaccgaatcaacccccttcttctcgaaagcctttcaggatcgtctatgccggtttgctgggcgtggcgcagaatatattggagttgatagagcgtatcgattttaaagggatgggagcggagcttcatttatttggagggggcaatcaagccttggagatagaggattatgtgaggacacatgataaaggggtcttttatcatggctctctgcccaaggaacggatgcgtgaggagcttacacgttaccatgcctccattatccccttgacggttcgtataaggggggcggtaccttctaaattatttgatttgctgccgttaggcgttcctatcttgttttgtggaggcggcgagggcgaggagattgtaaaggagaatcagttgggccttgtctcggcccccggagattatgagcgactttctaaaaatatacgggccatgagccacttgccggatgaggagtatcgacagctaaaagcgaactgcttaagattatcccagacaactttctgttttgaaaggcaactggaggcgtacaaacgttttttatcggctttctaatttcaggatgaaatcccttaaacattttgcggggatgccctgttatagatatagtagtgtgtttttcatggtattagatttttagattagtaattaggttgttcattcagttcgggagaataggatgttggtttctaaatatgagagccggaaaggtgagaatgatttctctcgtttccggctattcttttttatttaaaactcgtcattggcgtaaagactcaataggtttttcagctcataatcgaatatctcgtcatccttgaagaagcgtttcaattcgatctcggctgtctccggtgagtctgatgcgtgtacgatattctcttgtacgctcatactataatctccccgtatcgtaccgggagcggcgtttctaccattggtagcgccggccaaggttcttactacatgtatggcatctaccccttcccagcaacatacaattaccgggcatacactcatcgcgtccttgatccgttggaagaaaggcttttcttttaggtgggcgtaatgctcactcaagatctcgtcagtcagccaaaccatcttcatgccggccagacggagtcccttcttttcgaaacgggttacgatttcaccgatcagccctcgctgaacggtacaaggctttaaaataaccaatgttttttccataagatttatattaaaagattaaacaaatgtttgatgtcttgaatacatgttaaccttgcggcgttttatgaatgatagaggaataaaggatgaaatgttttttaggatatttcaagtatatttctatcttattcctccgcaagttaatgggaataaacaaataaacgagcgataagtctgctaaactaaactaatttaacatacgttaattgttgctcgagttgttaatccttctgtattcttttccatttccgtggaatttccggatgagtcttgagaaattccctcaaggtttgccggtttactcccagtttcttgctgatatatactttagtcttatgttctttaatatactgcaagatcatctcttccttaccttttagcttacaggtttccggtcgctctcctttcggacggcccagtttggcaccttgcacttttttccgagccaacgcttctttcgttcgttgcgaaatcaggttgcgttcaatttcggcgcttaggctaaatgcgaatgccaagattttactgttaatgttatttccgagttcgtaaccttcctttaccgtaaatacaatgatgtctctttccatacattgatgaaggaagctcataacttgcataagattacgtccgagacgtgacagttccgtcgtgatcaggatgtcgcctttacgtatttgctttaataatttaccaagttggcgatcggcgattacttttgtcccgctgatcgtctcatctacccacctgtcgattctcatgttcctcgattttgtgaatttctcaatctcgaatcgctggttttcagtagtttgtttgtctgtactgactcttacataaccgtataccatatgtcctatatttaattaaacaacaaccaagatactggaaacggattgattgatagtgcgttttagtaaaaacaaacttttttatgggtgtgttaaagaagttgagtgggtttgaactccatacaaattgtaataaaaagggttaatggatatccgtatagaaaatttaagttacttttgctttcgaaaaataagatggagtcttagaatgatcatgggtatgaaaaagttattgtctttacctccaaatttggtagattgtttccatgcggtagagcatgtaagtacagaggaatggttttgcacctcggatccggtaggcgcccgcttagggtccgggggaggaacgacttggttgttggaggcctcccggcaaaaagaggctccggatgtaccgacggaagagtggttgggacaggagaagcgtatcttgttgcatgccggagggcaaagccgccgtttgcccggatatgcgccatccgggaaaatattgactccgatccctgtgtttcgctgggcaagagggcagaggttatcccagaacttattgtccttgcaattacctctttatgaacggatcatgaaaaaggcaccggaatcgcttcataccttgattgctagcggtgacgtatatatccgtgctaaccagcctttgcaggagattcctgaggtagatgtggtttgttacggtttatgggtcgagccttcgttggccaagaatcacggggtttttgtatcgagccgtaagtctccggacactctggacttcatgctacagaagccttcgttggaaactttgggggaattggcgggtagtcatttattcttgatggatatcggtatctggctgctaagcgacaaggcggtgcggttattaatgaaacattcctataccgaggatggcaaggcgatgaaggcgtatgatttatatgctgaattcgggttggccttggggaagaatccacgtatcacggactcggagttaaatcagctttcagtagcgattctgccgcttccgggtggagagttctatcattatggaactagccgtgagttgatttcctctacattggcggtacagaacttagttagggatcaacgtgcgatcatgcagcgtaaggtgaaaccacatcccgccatgtttgtgcagaatgcggtgttacaccagaaattgaccgctgagaattcggaattatggatagagaatagttatatcggtgagaattggacgttacgtggccagcaaattataacgggtgttccggagaataattggaacttatctcttccggaaggtgtctgtgtagatgttgtcccggtaggggaagctaattgggcggcaaggccctatggttttaatgacttgtttaaaggggccttgtctgatgtgtctaccttgtttatggggaaacctatcttgacttgggcgatggagcgagggatcaccttgggagggaatgaggatatacaaaacgcacctttgttccctatttgccaaaccgtggatgagctgggaaaagtgctgcgctggatgattacggagccggatagggaagagggaaagtttatttggctttccgcccgaaaattatcggcgaatgatttgtccgatcaagcgaatttacgccgtttagtagctcagcgagaagttttccgtaaaaaagactggtcattattggccgctaatcatgagaaaagtgtattctatcaattggatctttcggatgcggcggaaagcttcgccaaagacaagattgtcttaccgaaagcccttcccgaggataatccgttgatgaaaaggatacataatcatatgttccgttctcaggtgatgaagatctcgggggtagcgtataaggaggaggagcaaaaggctttcgctttgttgcgggaagggctggtcggttctgtcctcggaagtaagcagcagccgtgtttgaatgtctatcgggaccagatcgtatggggacgtagtccggtacgtatcgatttggcaggtgggtggacagatacgccgccctattgcttatatgcgggtggaaacgtggtgaacgtggcgatcgagttaaacgagcaaccaccgctacaagtctatatcaagccttccgatacccataagattatccttcgctcgatcgatctgggagcgatggaggttatctcctcatgggacgagcttcgtgattataataaggtaggatcgccgttttccatcccgaaagcggctttggccttggcgggatttatcccggaattctcggcggaggcttatgcttctttggatgtccagttggaagcttttggtagcgggctggagattaccttgttggcggcgataccggcgggttccggtttaggcactagctcgatcctcgcagctactgtgctgggcgctatctctgacttttgtggcttggcttgggataagaatgagatcggaaaccgcaccttgattttagaacaattactgactaccggcgggggatggcaagatcaatacggtggcgtattgcacggtttgaaactcttgcaaacgaacgagggttttaatcagaatcctttggtacgttggctgccggaatacttgtttactgatccggaataccggccttgtcatcttctttattatacgggaattactcgtacggcgaaagatattttgtcggaaatcgtacgaggtatgttcttgaatagcgaggcgcatttaggtattttgtctgagatgaaagcccatgcgcttgatatgtacgaggcgatccaatgcggagacttcgtgacttatggtaaatgggtcggaaagacttgggagcaaaataaggcactcgattccggaacgaatccggcggcggtggaagctattatctccaagatacaggcttatgccttgggatataaacttccgggagcaggcggtggtggttacttatatatcgtagcgaaagacccgggtgcagccctgcaaatccgaaagatattgactctttctccacccaattcgaacgcccggttcgtggagatgagcttatcgaataaggggcttcagattagtcgttcttgaaagtacgattggctttttagaccatttgttgctaattggaatatattgtatgtgttttggaacatttatataaatgatcctgttgtacttttgcggagtttaatgaggtgtcagatctgatggggaagagaattgtttttatatggcttttattggcgttcgcttgggtagcgaagagccagaactacatgataaaaggaatcgtgactgattctattacgggagaacctttgccttatgtggctgtgattttgaagggaactacgataggtgctacgacagatctggatggggcttttacgctctcctcttcatctaaggtacgtactttacaggtctcttatctgggttatacggagaaagaattgaaattcgttccgggtaaagcggaacatttgaagattcagttagctccgacaagtattaatttgtcggaggtgattatcaagccgggaaaggaaagatatcggaagaaggataatcctgcggttacctttatcaaaaacgctatcgcacgtagggagagcaacgatcctcgtaatcatgattattttcggtatgatcaatacgagaagatggtcttcgctatgaacgattaccaaccgaaaccgaaaaaggatggaaaggcgggaaagtttgacttcttgactgagtttatcgatacgttggaggtgggaaagacgatcttgccggtatccgaacgtgagaaaatccagaccgtttattaccgtaaagacccgaagacggaaaagagggtcgttctggctacgaaagcggctggtgtggatgaggtcttctcacgagacggtatgcaacagttcttgaatgaggtattccgggaagtgaatatcttccagaatgatattccattgttcttgaaccgttttgttagcccgatgtctacgatggggcctaacttctataaatattatttgctagacacggtggaggtcgccggacagaaatgtgtggatttgggtttcgctccgtttactccggagacgttcggttttacgggacatctttttatcacgttggattctacttatttcgtgcagaaggttaagttgaatgtcccgaagaagatcaacttgaattttgtcggtggaatgacgatcgagcagactttcgaccgtgccccggatgggactcgtatcattacgaaagatgatatcaacgtggacttcaaattgacggagaaatcgaaaggaatgtatgcccgccgtttgaatatctattcgaatcaagcgtttgagggacccgatgatcctaaagtattcgaggagagcgcacctattattataccgatggaagcttatcgccgttcggcggatttctgggaggagaatcgtcctactgaggcgggaactcgcaagcagaataacgtggagttgctaatggcgaagcttcgttccgttcctattttctatgtgacggagaaggttgtttcgatccttacctccggttatatcgcgacgaataagattccggagaagagcaagttcgagtttggtccgatgaacacctatatcagtggtaacgcgattgagggggcccgcttccgtgtcggtggaaccacgacaacggcgttcagtaaacgtcttttcttggatggttatttggcttatggatcgaaagaccgcaagttgaaatatgatggtatcgtagaatattcttttatcgataagaaggattatcggaaagaatttcccgtgcattctattcgcttcgagtacctatatgatatcaaccagttaggtcagcagtatatgtataccaacaaggataatatgttcttggccttgaagcggcagaaagatacgcgtgccacctatttaaggaatatggaactgacgtattaccgtgagcattataacggctgggcttatggggcggtacttcggaattttaaggaatactcaaccggttacgccgcattcgaccgtatcggtccggatggccagatcacggctaccgattcctaccggatgtcggaagtggagtttaagttccgtttcgccccgaatgagaaattctaccagactcgtaattaccgttatccgattacgcttgacgcaccggtattcaccttgaaccatacgatggctttccaagatgtattaggtagttcgtatgattatcagaagacggagcttggtatccagaaacgcttttggttctctgctttcggttatgtggatattctcgctaaagcaggtaaagtttggacaaaggccccttatcctttgttgatcttgccaaacgcaaacttgtcgtatttggtgcaaccggaatcttatacgaatatgaacgcgatggagttcatcaacgatgagtacgcttcgtgggatattacttatttcatgaacggagccttattgaaccgtattccgcttatcaagaagttaaaatggagagaggtcttttctttccgaggtatgttcggccacttgacggataagaataatccgtatatcagtgagcaaaatgagggcttgttcttattcccgcagggctcttacctgatggacccgtctactccttatatggaggcgggtgtcggtatcgagaatatctttaagttcttgcgtttggattatgtatggcgtttgacttataaggatcatccgggcatccagacaaagggtatacgttttatgatgaaactgacgttctgatacgctttatttccagtcgctgaactcaaagctcaattgttcccaacggtctttcgtatgaggctcctcttttacggggtttgatacggataggccgatcagtcggatgggatgctcggcatattccacttctttcagcaattccttggccaagggaaggatcttgtctaaggttgttaactcttccggacggctgaggcttctcgtgatttggttgaaatcgtggaacttgacctttaaggtcagtgtgtttcccttgaatccggaacgttccagcctgccgataagttcggtcgctacgtgataaagctcgatgataacagaggatttgcgggagatatctttttctagcgtatgctcgcaacctaccgacttccggattcgtaccgcttctacgggacggttgtctatacctctggcaaactcataataaagtattcccgcctttccgaactggcgggtaagcatctcccccgaacattcccgtaattgcagcccgttgtggataccgagtgtatgcattttccgggctgttacgggacctactccccagaaagactcgatgggaagacgggctatgaaatcgagggcttggcttggatggatggtgcataatccattgggcttccgataatccgaggctattttcgctagaaatttgttgtaggagactcccgctgacgctatcaggttcaaattatcccagatccgtttcttgatctccttggcgatatctacagcgagagagatgcctcgtttattatcagtgacatccaaaaaggcttcatccaaggaaagcggttctatgatatccgtataatcatggaagatctcgtggatctggcgtgagacggatttatatacgtccatccttccatgtacgaatatcaggtccgggcataaacgtttggctttttgagacgccatggcggaacgtaccccatatttccgggcttcgtagctagcggcggctactacgcctcgctgctccgcatgcccgaccgctaggggttttcctcgcaactccggattgtctcgttgttccaccgaggcataaaaggcatccatatcgatatgtatgatctttctcaagatagctcttttattactggtatttacgataacccttcgtctgtttatgaagccgataatcgcattataagatctctacggagttaatgacgatattctcggtcggacgatcttgcttgttggtcttggaggactgtatggcgtctacgacatccatgccttctaccacttcgccgtaaaccgtgtattgattgtcgaggaacggtacgccaccttcgttcttgtaagcctcacggagttccgggtttaactttacctcgtctttccgcttctcggcctccagctcggtcttgccaatcaaggtatcacgaaggatcgccagttcttccttgttaccactgcgatagaattccatgatcttaggcttgttctcgttttgcaggcgggcgaatatctcttgtttcagacggccttccaattgcttttccatctggttcaactcttgttccgaatactttttccccgttacgatatagaattgggaggcggaagaggccttttccgggttcacctcgtctccggtacgtgcggcgcaaagggctcctttcttgtggaaatatttcgggtaacggaattcggcgggaacggtatagcccagatcgcccgctcccagttgcttgttcatcggggcatccttggaagtcacgtcacctccttgtatcatgaaatccttgatcacacggtggaacagcaagccgttatattgcccttcttgtaccaacttgataaagttatcacgatgtaatggcgtgtcgttatataatttcagctttatatctcctttgttggtgtgcataagcacccttgtctcagttgcttgattttccattttatacttatttttctatgagtttcattgacttgatctttatgttcttcgtgggtctgtcatcggcgttcgtctcgacgaactgtatcttatccacgactttcataccctgtataacctctccgaacaccgtatagttcccgtccagatgaggcgttccgccttccagcatataggcttctttttgctccggcgtaaactcgatgcctttctccttggtcatcttatctagctccatctccgtaaagaactttccggtcacgatatagaactgagtcgctgatgaggccttctctggattttcctcatccggggtacgtgcggcacagagcattccccgcttatgaaaatatttcggatacacgaactcggcggggatggtgtaatctagatctccgtcgcccagatgcgcatccaaaggagcgtctttcgagttgatatcgcctccttgtatcatgaattgcttgataacccgatggaacaataatccatcgtaacggtgttcttttacgttcttgataaaattatccctgtgcaacggcgtgtcgttgaacagtttcaccttgatcttacccatatccgtatcaatcagcaccaatgtctcagtctcttgcgcatgcagcgggcatagcgaaagcataaataccgaaacaaacaacatcgtaagaatccgtctcatatttatttctattagttttagatggacaaaaataagaataaatatcgatatctatgatcaaaggaataggtctaaacatgatttctttggtaggaaaccgtaatagcgttacaaacatctgtaatatatgcacatcgttttatgttgaatctaggtaattttgtcatagaaataaaactctaaattcaatatactatgagagcaagtatcttagctattttaattttaggggggattgtcttaaacataaaggctcagttttcttataatgaaaagggtcaagccatccctcctgcatcacaacctttcggcaaagaggcttttgagccaaccgggcatacggttatacgctggttggggaacgctggctttctgattaatagccgtggtacgtgtttgatggtcgatcctatgttgaggggatttgatatgcctttgttaataaatatgccgatcgcccctaaagatgttccccatttggatgcggtattgattactcattgcgacaatgatcattacagtgttcctacttgtacggaaatgtcttctgtatgccgggaatatcattctacattctacgtggattctttgatggaaacacagggtttgaactctttcggacatcgtatcggggagacttttaatgtcggtccgatttctatcaagttaaccccggcttaccatacgtggcaaaatgagtatccgggatatacgcatgaatttaaggttgaagattattgtggtttcctcatgaaaacaccggatggcttaatttgggcaccgggagattcccgctttcttcctgagttcttggaattacctgccccggacgtgattttctttgatttctcggatgattcatggcatataggattggagggagccataaagatcgcaaatgcttatcctaaagcgcagcttctcctgtctcattggggaacggtggatgctcccaatatgaaatcattcaatgctgaccctaaaatgctagaagggcgtatccgcaatccggaacgtgttcatgtcttagccccgggagaagcttttgaccttgtagctctcagctctagcgagggtgaacaatgtgccgaaaccttgattttccctgccgacgcaaaggcttcgtcggagtataatacgggggatgtctatgtctccttgttgaaggagtctggtaatacgatgatcgcacattttatattcaaaccttacagtcgtaatttctggcattaccatccggatgccgagcaaaccttgttagtacttgatggagaaggatattatcaagaggaaggaggagagaaacgtgtgatccggaaaggcgatgtgatcgtgacacctcctaatgtacgccattggaatggggcgacaccgggtagctctatcgtatgtatgaccgttacggaacatgcgatcgagaatcatgccgtacaacttcgggctgtgacggataaggagtatgctaattagaatacttgtccggggcttttaggtgaaagatacgtctaaaatatcgctaggataaggaggtattgattttttcacaggggtgaaaagatcgtatcacccccgtgaaaagatcgtatcacccccgtgaaaagatcgcttcacaagggtgatacgataaaaatcttaggccacggctgttacttcctgctgaggaatcagccataagaaccttataatcagaataatttgcttggatactcgcctgcgtctaccaaggcttggatcttatccacaacgccttgacgatccgccgcgtaagttacgccgaaccatttggaggttgtatccaatactttcacacgggctgttccttccgtgatcaatttatttaccatcaacgggatgaaatattcactctttaaattacccatgttcgctttcaagaactctttgaagaattcctcggaatactcgaaataatcgggagtgaagccccacatattcatggataccggcgtattttcttccaatacgaccttctttccgttctcgtctacaaactggatatctccgtcgatacgttcgatagcggtacgctccacgacgcctgtcagataaccttcctcgttcgtggcgcaaacaccacgtgccacggaaccgctctcgctcaacgtattacctacacggtagcctaccatgcaataatcattcttcttgccatccatctcagacaattgcttgcctaatacggcgaagctgtcacgtccgtagaaatcatcggcgttgattacggcgaaaggctcattgataaccttcttgcccatcaatacggcatggttggttccccacggtttctcacgtccctccgggcaagtgaagccctccggaagatcgttcaaatcttggaatacgacttcaaccgggatatggttctcatatttggagatgattttctcacggaagtctttctcgaaagatttgcggataacgaatacaagtttaccgaacccgccacgaatagcatcgaaaatagaatagtccatgatggtctcgccattgggacctaggccgtccaattgttttaatcccccataacgactacccattccggctgccaatacaaataatgtaggtttcataatgcgtttctttaatgtgttttttaattcttcgggcaaagttaataattatagaaacattgccatgttattgtccgtctttttataaaacttctaatacgacgatcgacatgggaggaaggctgacgcttaactttcccttttccaccttggctcccttgaaaacttccggcttgaccttctccggcgaatcgaatgtgttatagtcgtttatggaggacgctgtcaggatacgcccgttcacgctctttatcgttacgttttgcaggtcgatatggatgttctcgctttgccggggatctacgttcgccaacgagatatggattttaccctgcgagtcccgggatgcggaggcgcttacgaccggcacttcccggttgtctcttactttctccttgtcgcagattagatccatcggcaaaaaggtagcgtcttgatgaaccttgtacatctcgaacacatggtaagtaggcgtaagcaccatgtccttgcctttcgtgaggatcatggactgcaatacattgacaatctgtgcgatattggtcattttcactcggtccgtatatttgtggaagacatgtagggtaagagcggccacgaaagcgtcgcgcatcgtgttttgctggaacagatggccggggatcgtaccgggttccacatcccaccaagtgccccattcgtctaccatgagggctatatttttcttcgggtcgtatttatccatgatagcgatatgctttttaacgacatcctctatctcaaggcattttcctaaggtccagtaataatcctccgtgttgaaatcggtagcggagcctttattgttccaatctcctactgtataataatgtaaagagataccatccatgcgtccgccgatttgtttcatcagcgtctcggtccagttgtaatcataatcgctggcaccgctggcgatcttgaacaagacattgctatcatagttacggcaatacgtagagtaacgacggtaaaggtcggaataatattccggtcgcatactgcccccgcatccccaactctcgttcccaacgccgaaaaacttgactttccatgccttatcccggccatttttccggcgtaggttggccatagggctgtctccttccgaggtcatgtattccacccatttagccatttcctcaaccgtaccgcttcccacgtttccgctgatgtaaggctcacaacctaataactcacatagattcaagaactcatgggttccgaaactattatcctcaatcgtccctccccagttattattcaccattttcgggcgattttccttggggccgattccatccatccaatgatattcgtcggcgaagcaaccgcccggccaacgtaagttcgggatctgtagtttcttcaacgcgttcaagacatccgtacggtatccttgggtattagggatgtcggactccggccccacccataagccaccgtagatacaactccctagatgttcggcgaattgcccgtaaatatgtttactgatctgttggttaccttgctccggataaatacggatattcgcatctcgctgagcgaataagggaagggcgataaatgcccaaacgctgattattagtttcttcatgatataaatgatttgttggcaaagatacacttattcttgaatacatgaatccttttatcgttcgaaaaacacgtacgtgttttcggaaaaagtcgtacatgttttaaaagaaacacgtacatgtttttcttttgtgtatttatcgtatctttgtaaggttttaaggcaaaagactaaacaaaatgagaaagagaaaaatgtttccgtttttagcggctgggatagtcgctttagcgagttgtaacactcctcagaaagaggtagtgaagatcgctgctattaatcctgcgaatatggataccacggttgccgcaggcacggatttttatgaatacgcttgtggtggatggataaagaataatccattgaaaccggaatacgctcgtttcggaactttcgaccaattactagagaataaccaagaacagctccgggtattgatcgaggaacttagcgctacgccccatgaggcgggcagtgtcgccgggaagatcggtgctttgtatgcgatgggattggatagcacgaagttgaatgccgatggagtggctcctatcaaagaggaactggccgctatcaatgcgctggcgacgaaatcggatgtctctaagatggtggctacgcttcataaggaaggcatggctccgttcttcgctttgttcgtgggcgctgacgagaagaatagtgccatgaatatcgtccagctgtatcaggctggtatcggaatgggcgatcgggattattatttgttggaagatgaaggttccgctaagatgcgtgacgcttacagggcttatataaataagttatttacgttggccggctcaagtccggagcaagcggatgcggcggtggatgccgtgatgaaaatagagaaggctatcgccgagatctcttatggccgtgaggatttgcgtgactcccaaaagaactataataagttggcttacgaggatttcaagcaaatagaatccccgttggattgggatgtatattttgaatccatgggattagccgggctgaaagagttggacgcgaagcaaatcaacttctataaggatatgaataaggctttgcagaatacgacggtcgatgagcaaaaatattatttggcgtttaatttattgagcgcggcggctccgtacctaagtgatgattttgtagacgctgattttgagttctatggaaaggtaatgtccggaaagcaggaacaacaacctcgttggaagcgttcgttgaatacggtaaacggtgcgttgggcgaggccgtcggcgagatgtatgtagagaaatacttcccggcttcttctaaggaaaagatgttgacgctggtggggaatttgcagactgctttgagcgagcggatcaatggtttggaatggatgagcgatacgactaaggcgaaagcgcaagagaaattggccgcttttacggtgaaaataggttatccggacaaatggcgtgattatagtggtttggagatcaaggacgattcttattgggcgaatgttcgccgttctaacatcttcgatatggcctatcaattggcggacgtggataagccggtcgataagtctcgttggcatatgaatccgcagaccgtgaacgcttattacaatccgactacgaatgagatctgtttcccggctgcgatccttcagcctccattctttaatccggatgccgacgatgcggtgaactatggcgctatcggcgtggtaatcggccatgagatgacgcatggattcgatgatcagggacgtaactacgataaggatggtaatttgatcgattggtggactgccgaagatgctgttcgtttcaaggagcgtgctgataaattggttgatcaatatgaccagattatcgtaatagatacgcttcatgccaacggacgttttacgttgggggagaatatcgccgaccacggaggtttgttggtcgctcaccaagcttatttgaatagcttgaagggcaaagagactccggccccgatcgatggcttcacgaatgagcaacgtttcttcttggggtatgcgacgttgtggggacaaaatatccgtcccgaggagatccgtcgtcgtaccaagatcgacccgcattcattgggaaaatggcgtgtgaacgctgccttgcgtaatatcgccccgttctatgccgcttttgacattaaagagggtgatccgatgtttatggctccggctgatcgggtggttatctggtaatccaaatacagagtttatataagtgagggaagtatgtcacgtcaaaaaggcatacttcccttttttcgtttatcccgatttggcggtctgatgcacttttcttatttttgtttgattaagaacgttatacatgaaaattttataccatgcgaaactatatatcaatcgccttacttctcttggcatcttctgtttttgcgtatgatcctcccacgatgggatggagctcatggaatacctatcgagtgaatatcagcgacaaactgataatgaaacaagctgatgcgatgtcgcggaatggcttgaaagaggttggatataaatatatcaatattgatgacgggtattttgggggacgggatgcgagtggggagttaatcactcatccggtccgttttccgaatggcttgaagcagacggtagatcatatccatgcgttagggtttaaggcgggtatttattccgatgcgggccggaatacttgcggctccttttgggataaggattctttagggatcaatgtcggcttttatgggcacgatcgtcaggacgcagactacttctttaaggaaataggattcgattttattaagatcgacttttgtggcggcgatgccaaacagaatttcgatcaattaggtctggatgagcaagagcgatacacggcgatccataatgcgatactagctaccggccgtaaagatgtgcgtatgaatgtatgtcgttgggattttcccggtacgtgggtgcatgacgttgccttctcatggcgtatctcgcaagatataaatcctagctgggagtccgtgaagaatattatccggcagaatctatatttgtccgcttatgcgagcgaaggaaaatataatgatatggatatgcttgagatcggccgtggaatgagtgaggaagaagataaaactcattttggaatgtggtgtatcatgagctcccctttattgatcggctgtgatctgactaccatctctgagaaagctttgcggctactgaaaaacgaggaactgatagcgttaaatcaagacgtactaggcttgcaagcttatgtcgttaagcaaatggatggagtgtatatcttgacaaaggatctggaagaagtgaatgggaatacatgcgctgttgccgtctataactctacggatgaggaacggactattcatctggattttgccgatttctatttgcggggcgacgtgagtgtacgggacttatttgaaaggagagatcttggaaagtacaaggatcgggatttttccgtaaccatacctgcgcatgggacacgtattttccgtctggatggactggaaaggggagaacggacggtttatgaggcggaatgtgcttggctgcaagactatcaagaaataaaaaatcacaaagcgtttggaacggcgatttatgaggatgacgggaattgctctggaggtgcgaaggttacgggattaggtaatcgtgatagcaattatctggaatggcataatgtatacagtcgtgagggaggtttatacttgatgtccgtggattatcagtgtgcggagaatcgagaattaatttgtcaagttaatggagttgtcgtaaaaaatgtagaggctcatcctgcgcatgaggtcgctagcgagcaaatagagatccgtctgaaacccggtatgaatcgcatacgcttatcgaatggaaactcatggatgcccgatatcgatcgtatggttttacaaaagaagtgattgccggctacgtgcttgagggaattttcattcttctatattcttgaggtgtcattcccgtatgctgcctgaaatatttgttgaaaaaagacaggttgttaaagcctaaagagaaagcgatctcttttacggttaagtctgtcgatcttaattgtgccttggcatccatcgtgataatggaggaaatgatttccaagggagtaagtccgatcgctttcttaatagtcgtgcagaaatgaggtaacgacaaatttaattgagcggcgtaaaaagaaacgctgtgctcggtggtataatgctctacgacaagttggataaacttacggtaaatctcattggtgcgcgtacggattccatttgtccaatggctatgatttttatataactcagccgttccttgcatgaatatcgtgagataagcgatgactaggtttttatttaccatagaataagacggggataaggattgcgcacgtatcaataaacggtatccgtcaatatataattgagctacagattcttccagcggcatgatcggatgttccgtgataacgggaagaaagctcatggttgatttaataaaattgatgtttgtcataaactccgaagagaatccggcgaaatagaaacgtgcgtcgtccgatatttcatggaactggataaaattgctgggcactaaggtcacgaaatcatatttgttaatcgtatacttcgctagattgatagaagcctgcacggaaccttctacacaaaggagaaacaaacctgcctttatcttatgaggcagcttgctgtatttgtttagcgtctcttttgtgatacgatctccgacgataaaatcgttcgtgatatcgaatgtgagcatttccttttccatatctaatcggtaattcgtctcaaatataggaattaataaatacttattattcaagataataaaaatagaacatagaaacgaaagaatggatattgattccctaaaatttaagggcgaactttacaaatgactactaatcgtaggaaagaggaaacaaaaagaatatagttcgtttactagaaaagtattttgattatggaaaaaggaagaattggactaaacgcaggaaaagtgtggcatgcgctaaacgaggtaaatgaaatatctacgcaagagttaagccgtaaattgtctttaagtattgaggacctagccttggctattggctggttggctagagaaaacaatatttatatcacgagaaagaatggtttgttgtatgtcagcaatggcatcaaatccaatatgtactattagaaggaaacaaaaaaaggctatccatcacggacagccaatcttcattgttaaccttaaatctaataccatgaaaaacacagtgcaaatatagaggtttttggaagtggttagttattcacttgggaagcctttctcaagtgagttggcctgttgattaacaggatataagacagcgatttatatggcaatggttatcccatgatctcatctgttggccgacttctatatttctgtaggtcgacttgtcttaggttgccggctgaaatgaaatatagatgagcctgaagatacccccactgattatcgggtgagccgaattttcttctgataaggcattggagacaagacttataagcaataaaaaaacctacaaatcagcgatttgtaggtttttgtccacttactctcttgttttgttcagtaggttctgcggaaagacagggattcgaaccccgggaacctctcggttcaacggttttcaagaccgccgcaatcgaccactctgccatctttccaatatgttgtgcgatcaaacgtttcgtttaattgctttgcaaaggtagtcattcttttggaatatacaagagtcttatgcgctttttttctttttgtttattcttttcttttaagaatagaatgtgtgggaatcccctttttattgctatttttgtagcaaataatttatcaatcaagtaaaaggtttctatatgagaaagttgaaaagtttatggctggtttcggttgtgctgctattagtaagctgctcgatgtccgctaaatcagataaatcaagtgaggctggtaccgcctccaagggagaggtcgttactttgaacaaggcagagttcctgcaaaaggtattcaattacgagaagaacgctacgaaatgggtatatgaaggtgataagccttgtatcatcgatttttatgcggactggtgtggtccctgcaagcaagtggctcctattttaagggatttggctatcctgtataagaatgatatcgtagtttataaggtaaatgtggataaggaaaaggagttggctgccgctttcggtatacaaagtattcctacgttcttgtttatccctaaggaaggacagcctcagatatcgatgggagctcttccccgtgaggagtttgtgaaacagatcgatactttcttgttgaagaagaagtaacacgacttagttaatcatcatttatagatcggaaagccgtagaattttagattttacggcttttttaattgggagggatgctttatgaaagtaggaattatcagatgtatgcaaacagaggatttttgccccggtactactgattttaggatgatccgtgagaaaaagggagcctttgagggtgtagaggaagatattgagatcattgggtttatcaattgcggaggttgtcccggaaaaaaggccgtattaagggcgagggagttggtgaatagaggggcggatagtatcgcttttgcttcctgtatccaaaaagggacgccgataggttatgcctgtcctttcgccaaaaggatgaaggatgttatccagaacgatttaggcgatggcatccggctgatcgattatacgcattaggaagatccggtagctggtggaaaaggcataaaaaaagagggcattgaaaaatgtcctcttttttattttggcatcgcacgaattattcagcgctttcagttgccggagcttcttcagcgggagccgctgcggctgtttcctcagcttgcttagcagcttcagctgctgccaattctgctttctttttagctacgatttctgcttttgccttattcgcttccttctcagcctcaagacgtgctttagcttctgctctagctgcttcgctgtctttttctttgatagcttgtacggaagcttgtttgttcttcaaccaagcttggaatttttcctcagctgcggcttcgtcgaacgcacccttcttaacaccttccaataaatgctttttcaagcaaacgccttcgcgagaaaggatgttacgagttgtgtctgtaggttgagcacctacttgtaaccaatacaaagctctttcgaagttcaaatctactgtagcaggattagtgttcggattataagaacctatcctttcaataaatcttccatcacgtggagccctgctgtctgcgatcacgatttggtagaaggcgtaacctttacgaccgtgtctttgcaatctaatttttgttgccatgtttgaataattaatttaagctgtttgtattagcgggtgcaaagatagggctttctgtttataaaacaagcgtttcatgggaaaatatatggatgtctctgttttttttaaaggtagtttaagggattagttccttatgaaattggttgccgacggcgtcggcaataatgctgacgctgtcggaaagattgctgacggtgtcggaaatactgccgacgccgtcggcaaccaatttcttcctagtcttgccccggaaagatcgtatgaaatctcctgtacatccctaatgaaagggatttttcttatctttgcggcttcattatattaatgtattaaaataaacatatgatttcagttgacggactaacagtagagtttggtggaagcgcccttttctcggatgtttcttttgtgattaacgagaaagatcgtatcgccttgatgggtaagaacggtgccggtaaatctaccttgttgaagatattggccggcgtgcgggagccaagccgtggaaaagtgtccgcccctaaagataccgtgatcgcttatttgccgcagcatttgatgacggaggatggccgtaccgttttcgaggagacggcgcaggctttcgcccatctgcacgagatggaggcggagatcgccgaattgaataagcaactggagactcgtacggactatgagtcggatggttatatggagttgatcgagcgggtctctaccttgagcgagaaattctattccatagaggagatcaattacgacgccgatatagagaaaaccttgttgggactgggtttcaaacgggaggatttcgaccggcaaaccagtgaattcagcggtggctggcgtatgcgtatcgagctggcgaaactactgttgaagaaaccggatgtccttttgctggacgagccgacgaatcacttggatatcgagtctatccagtggttggaggatttcttgatcgataatggtcaggccgtagtggtgatcagccacgaccgtgcgttcgtggatcatatcacgactcgtacgatcgaggtgacgatgggccggatttatgattataaggtaaactatagccaatacttgcaattacggaaggaacgtcgtgagcaacaacagaaggcttatgacgagcaacagaagatgatcgccgagacgagagagttcatcgagcgtttcaagggcacgtactccaagaccttgcaggtgcagagccgtgtgaagatgctggagaaactggagatcttggaggtggatgaggaagatacctcggctttgcgcttgaagttcccgccttcgccacgttcgggctcttatccggtgacgatcgagaatgtctcgaaagcgtatggcgatcatacggttttccgaaacgctaatctgatgatcgagcgaggggataagatcgctttcgtcgggaagaatggcgagggtaagtctaccttggtgaagtgtatcatgaaagagatcgagcatgaggggacgttgacgctggggcataacgtgatgatcggttatttcgcccagaaccaagcctccctgctggatgagaatcttacggttttccagacgatagacgatgtggcgcaaggtgatatccgtaataagatcaaggatctgctgggtgcgttcatgtttggcggcgagaactcggcgaagaaggtgaaggtgctttccggtggcgagcgcacacgtctggctatgattaagctattgttggagcctgtgaacttgctgattctggatgagccgacaaaccatctggatatgaagacgaaggatatcttgaagcaggcgttgcttgactttgacgggacgttgatcgtcgtatcccacgaccgtgatttcttggatgggctggtctctaaggtctatgagttcggaaaccaaaaagtgacggagcatttggaaggcatctatgagtttatgcagcgcaagaagatggagaatctgcgtgagcttgagcggaagaattaaatcctccacccaagcgtcagcataatatcatacgtggagctatctatatctttatgatacttataatgggtacggcgggagaaataacgatttcgcaacgcaatattccatttatgcttggacatataggctaaggtggtggaaaataccgttaaacgtgcgttgccggcatcgccttgtacgtttaactttgtagggtccaccgcattccagtctatatccggctcgtatcctttccatgtgaagatatggtagttctccaaatcgatcaagaacgcccagcgtttatcgtaagccaatccggtaaacgctttcacgctataaccgcttcccagattataatctctctcttccagccggaggtaatcggagatgcttgcgcccaaggcgactcctgttccgtataattcggcgtaaacatctaccttattgtccggcgtgcctcttttgtaatagatcaatccaccaccgaccgccgccgcttccgatatgcggtagggagctaccgtttgggaactattggattttaactcggaatcatagtagtcgaaatgctgaaagattccagcggccagactacgagggcctttactccagacctgtttcccccagatagccccaacggcattgacttggctgatgagcggctggctcgaaaagaaatcgaacccggccttcaactgaaaccattcatagggcgaatagaagtcatcattgaaaggatctccataatccaacctgaaggatacgtgcatgctcgtagtgccatgcttggagccttcctgctcggcaaggaagcgaggaccaacacccacgatgaagtttacgggaaccgaggtgtagacacgccccttggagctgctgtgtctccaagcttctcccgtgatgatacgattgatcgcccgcatcggagatatcaaaccggataagatctcccgtcccacacgttccgccccgtgggagcggttgtcgatgaataagtcggagagccggtaggtaatctcacctaattctataccgccgaaagaggtggcaagcatgtcattgatggagggcggttccgtttccataaagaattcccacattaggctgcctcccgccgcgaatggaatggattgccagaaattcagtccattgctacgggccgcgttgaaatataacgatccgtgatagggatgggccaccagattggtagagaacttatccgtgtcccaaacaggccccgtcttgaagttttgcttaatcgtatgtccgtttatcttcgcgaaatcctcgttcattaagaaacggtcgaaagtccagacggccatgttcattccgaatacctcgtttgctgccaaccaagggcggcgtggaatgaaaagggccgtgtcgctcacgtaattgcgggcatccatctgagggaagtgttgcccccacatccattggctggatagcagacagatcaacccgatcaacatgcattttttcatcctcatctaactcaattctcttttgtaaataaaaatcaataggttacggttataaccactccgcaaacttatatataataaacattaagggattcgtttggtttaaattattgttaggtattctttctataaatgctgttatttgcgaactattccgtatttttgcgaaaaaaacaaaatgatagattttatcaccttttgtgactatacagggacctttgcgtttgccataagtggcataagattggcttctgcgaaacaatttgattggtttggcgcctatgtggtgggtgtcgtgaccgctgtaggaggaggtacgattcgtgatattttattgaatgcggtgcctttttggatggaacaagcctcttatttgattgtctcggccttggctttgttgttcgttatcgctttccgaaaatacgtgatccgtttgaacaatacattttttatattcgatgctatcggattggggttgtttgtggtggtaggtatcgccaagaccttggatttcgggtttcccatgtgggtggcgatcgtgatgggaaccataaccggctcgtttggcggtatgatgagggatatattgattaatgaggagcctttgatattccggaaagatatttatgcgttggcttgtgtctttggcggtttgatatattatatatgtatgcaaacttctatgtcggcggcgatgatacagttcgtatcggcgttgagcgtgttcctcgcacgtataatcgccgtaaaatatcatataagtgttccggtgttgaaaggagaagaataatttattaactttgcataattatatggacatgcatactcaacaagaaaaggcttccatcctgttgatatatacgggtgggacgataggtatgatcgagaatccggagactggagtgttagagtcgtttaatttccagcatttgaaggacaatatgccggagttgaagaaactggggtattcggtggccacgatacagttcgatcctccgatggactcctcggagatggggccggactcgtggatgaagatcgtgaaaatcatcgccgataattatcagaaatacgacggcttcgtggtactgcatggcacggatacaatgtcgtatacggcatcggcattgagttttatgctcgagaacctgagtaagccggtgatccttacgggatcgcaattaccgatcgggatgttgcgtaccgatgggaaggagaacttgattacggcgatcgagatagcggccgccaaggagaacggcttaccgttggtcccggaggtctgtatcttttttgagaatgatttattgagggggaatcgtacgagtaagataaacgcagataattttaatgcgttccgttcgtacaattacccggctttggctcatgcgggtatctatattaagtatgatctgccgcaggtatatcatccggtatcgcgtaagccgctgaagccgcattatttgttggaccgaaatatcgctatactaaaactattccccggaatttctccgcaagtagtggaaagtatcctgaatatcccgggtctgaaaggcgtggtgatggaaacattcggaagcggaaacgctccgtgcgaggaatggttcttgaatatgttgaaggaggctgtagaccgtggtatcgtcatcgtgaatgttactcagtgtagggccggaagtgtggagatgcaccgttatgagacggggcacaaattgttggaggcaggcgtgacgagcggcttcgatagtacgacggagagcgccgtgacgaagctaatgttcctcttcggccatgggctgacacccgacgaggtgaaggagcatatgaactgctcgttgatcggggaggtatcgatccctgagacgttccgcccctagtgtatactatgtaaaacagaaaaaaagcagtgttgcggaataggagagtatgaaactatcatttctgagtttagcgagtgggagcagtgggaactgctattatttggggacttcggaattcggtatgctgattgacgcaggtatcggaatccggaccataaagaaagtattgaaggaccggtcgatcgattttaccaagatcgtggccgtgttgattacccacgatcatgcggatcatatcaagacggtcgggtatttgggcgagaagctttgcattcctgtctatgcgacagccgacgtgcaccgggggattgataagagccggtatgtggaggagaccttatgtgtctcccgcaaggttatagaaaaagaagttccattccttatccgtgatttccgtatcacggctttcgaggtgcctcacgatagtactgataatgtggggtaccatatcgagtatggtaatcataaattcactttcgctaccgacgtaggccatatcacggacacggtggggaaatatatctgcatggcgaaccatttaatattggaagcgaactatgacgaggagatgcttcgtttcggtacatatcccgctttcttgaaagagcgggtggcgagccccaccgggcatttgagtaacagggaggccgcagagttcttggcgacccattataataccggtttgaagaatatctggctttgccatctcagccgggacaataaccatcccgaactggcctataagacagtggatatacgtcttttccaagagggcataagggtagggaaagatgtctcattggttgcgttgaagcggactacaccctcggatatttacgagtttgattaaaattttatgaaaaaaagtagtcgaaaagtttgcggggaaaaataaaacctctatctttgcacccgcaatcgagaaacaaacggtggtttgaaaaagtaacgatagcaaaatggaatgacttggtagctcagttggtagagcaaatgactcttaatcattgggtcgagggttcgagcccctcccaggtgaagtaccttagaaaataacagtaaaatctgtgaagtaaatttaggcatagtcatgaagttaacttactttgccgttgaagctaacttactttgaaatgttagttaactggtaactttctacctaataaaagccatttggcaatgtacctaatcttttttgcgctataaaagtgttttgtaaggtcattccataaactttagggtagtagtcttcgtactgtttgatggattgccatcttgattttttccttaataatcaattataattaaagaatatatcatatatttgcctagctagtaattaagacagaaaagcaaaaggtaaaagcgtaggtttttatctacttattctttctttgttggtagtaaaacaatgataaaatagaaaacgtatggattattataggctaaaatatttttaatacgtatatttgcgacaataaaaggcttttaagttagaagcctatatgtgttgcgtgtgatatttgtgcgatgtgataaaaatccgctaaatttttaacaactagagaagcacaaagaaggccccgcaaccctttaccggatatacgtgttatctatgctgttaaagtatggataagattattgtatatagataaagggggtgtgcggctgactttactcggttgtgggtcttagcggaacctttgtcacgtaatgttcagccaatcgccctttctttattttataatgaaaggccagctcttcaatataacgccaaataacgccctttttaaagataaatagtataagttttactttaatcaaatagttatgcctgagtttattactattgaagaagccgctcgtatcaccggctttccatctcaagaaatccagcaatgggcgatatctaaaaaaataacatcttacgtcgtgaagcaaggtgttcgcctagtcgatctgaccaatttgcgtgaattcatttcccatatcgagcgtatgggaatacaaaagctatacctgcaacttatcctccaagacaaggaagaagagataaacgagatcatctcccaattcgatgattaccttttctgcctgcgatcccttaaaaacatctctcccctacttaaactcattatcgccgaactatcaacattcatacacgacaagaaagaccgacttatctttacggaaataacttccggagccaagatagaagacgtagctaaacgttgtggtatatcctacgacggaatctgtcgccgatataaggtcatatcgctccgcttgcaagaaaacatgggcttcctgaccgaatacaagaaaacaatcacgaaccaagaccttgagatagaacgtctgtggatagagaacaggaacatggaatacgaattgagaagattatataaaaaggcgctccaaaacggtctatgtatcgaatctccccgatcacttacccccgttcccttaaatgccgcgaaacggatatgccaacccattacccgtctcaccttagcgccctatatccgtaaatgccttacaaccttgaaaatagaaaccatagaagatattctacgttacgccctcaaaaacggactcgactctttattagaccttcccggctttggcgctcttggtttggcccaactgaaattccaactcgaaaagcataagataatcgataaaaccgggcattccgacctttatcaatatatcattcgcgaagcggataattagtgaggacattctttgtcctcaagtagaatttaactagatttcaaggatactcatactgtatttacatttttttgtatatttgcgatatgtaatgatgcttgtttatatttggatatttattagtaaccttgtacttggttctgatgagaagtaccttagaaaataacagtaaaatctgtgaagtaaatttaggcatagtcatcctacaataccaaccttaccggacagatatacttcaagtaccacaggatatatacttcaagtgccataggatatatacttcatcgactaagtaagtagttaaaaagctattatcatttgcgattgtaaaggatttcgcttaatattgcaaatactttaaatcaatagtaataccatgacaactcgaagagattttctccggcagaccgctttgctcggtgccggacttaccatcagtccttttttcattaaagccgggagcgctggtgtgggcgcaaacgataagataggcgtcgggcttatcggatgtaacggcatgggattcgaagacctgaaagcgttccttcgtaatccggaagtagagtgtatcgccttgtcggatattgacgagaacgtattgaataatcgggcggcagagaccgagaagatcaccgggaagaaagtaaagcatttatataaagactggcgtaaattgatagacaataaggatatcgatctcgtaatcgtaggtactcccgatcattggcactgcctgcaaatggtatccgcttgccaagccgggaaggatgtgtattgtgagaaaccgctgggaaatagtatcgaggaatgtaacatcatggtacgggcggcgcagaaatacaaccgggtcgtgcaggtaggccaatggcaacgtagcgatccgcattggcaggacgccatgcaattcgtacatagcggacagctgggtaagatacgcaccgtacgtgtattctcttatcaaggttggtgcccctctatccccgtcaagccggacgaggcggtgcccgccggagtggactatgatatgtggctggggccggccccgaaacgtctgttcaatcggaaccgttttcatttcacattccgttggttctgggattatgcgggaggtttgatgacggactggggcgtacatttactggattacgcattgtatggcatgaacgtcaccgcaccggagtctatcatggcttccggaggtaaatttggttatccggatgacgcttgcgagaccccggacttattgcaaaccatttatacattcaaggacttcaccgttatgtgggatcatgcgatcggcattgacgacggggcctacggacggaatcatggcctaggattcgttggcgagaacggtaccttggtgatcgatcgtggcggctgggaggttattccggaaaaggtaaacggacaggcccgcatggaggctgttcccttgaagaagtcatacggagagggtggcttgaatttgcatgcgaagaatcatttggaatgtatcaagagccggaaccggaattgcaatgccagcgtagagatcggggcgcatatcgccaagttctcccaattagggaatatagcctatcgcacgggtaagaaattatcgtgggatggaaagagtttccatgatacggaggcggataaactattgtgcaaggaatacagggcaccgtgggaattaccgaaaatataaggatctagttgtagggacggggcacgccccgtctctacaactgggtatttattgatgttcggggcgtaacaggtcgttcaccgtcttcacggggttgaatgtctcgataggaacttctacgaataccgtgttccagtcgctcatggcaccgttccacaagcccggcaattccagcgctttcaattcgcggccatccttgctcttataagagatgaagcccgtattcttatccacgtaatccggcaagttgtatttctctcccttgtgattcttaacggcgcaaaccaaatccacgggattaaagtgagtacccttctcaaacatcgccttcttagccggatcgctcatatcgatctgggagctttcaagcacctgcaaggaaaccgtaccgtccggattcaccgcaaggaacggaccgccacccggctcgcccacattcttcaccataccgcatacacgcaacgggcgaagcagtttgctcttgatatacaggattaactcggcgtcttccagtaatttcgtatccgggttcttgatacataggtcgtcttgcaagaaatgaatcatctcctctacctcggcatgggtatatttgccggtctcgatctgttccagatatctgaaggctttctcctgcaatgttaccaagacaccggcgatcaccttcttgtagataaccgtagagcatttgaagctatccggaaccacgttatctatattcttgataaataccacgtcggcatccacatcgttcaaattctcgatcaaggctccatgcccacccggacggaacaataacttatcattcttatcgcggaacggcgtgttatccatagcggccgctaccgtatcagtactcggtttctggatactgaaagagacatcgtatttcacagagaacttctcctcgtactcgccagatttatcggcaaccaattgctcgaataaagcctgatgctccggagataccgtgaaatggatattcacctcgccggcgttattcttggcgtacatggcgccttcggccaaatgttcttccatcgccgtacgaaccgtatcggcatatttatggaaaagcaacaagcctttcggtagctgtccgtaattcaagcctttcggctccaataaattggataccacctccttgtactcgcccaaggctaccaacgcaggaatatctttccctgtattctccacgcacttcttgtccaaagccttatagaaagcgaatttctcgatctcgctaaagaatttcttctcgaaagcgttcatcggttccttataatccgcagaaaggaactcgtacagattcttaaacatacggctagcagcgccggaggcaggtacgaattttacgattttcttgtttttagccagataagcgtcccaagcatccatataagaagcctgttcctctttagatattaccataatacctttttctaccgaagcggaggccgctatctcaaggaaagggaaaccttttacgaagcaagcgagttgctcttcaatctgtttttcgctgattcctttggctttcagctgttctaaatcgtttgcgtttaacatagtatagtatttaatgtgaataatctcatcagtaacaccacagggcacttatgcgctatgtgtatcgcaaatgtataaaataaccgcaagatacatgttgaaattccatagaaaaaagtatttttacagcatgttttgcggtttgtcctcaaccgggcaataaaaatgatataactatggatacaattggattctttacgtctgaggaaaagaagctgttcttctccaaatacaggctcctgttacgaaacctttactctttcctcgagagggaagatatccgaaagatgaaggagctgatgaagcgggttgtcgccctcgattgctacggcagggataagaatggtatcaacggtttattgcgaaatattgacacggccttgatcgccaccttggagattggcttgaaacgtacctcggtcatcgccctcctattataccgcccggtattgaagaaggcgatcacgatagaggaagtggagctgaaattcgggacggacgtgaccttgatcatccgtcgcctcttgaagacctccgacttgtatgcccggaacaccgccgtcaactcggagaatttccatcatttgcttttctcgtttgccgaggacgtacgtgtgatcttgcttatgatcgccgaccgcctctgcctcatgcgtatgggaaaacagatgcaagaggatgatcgtatccggctggctaccgaggcctcttatttgtacgctcccctcgcccaccgactgggtttatatacgatcaagagcgagctggaagacctttccttgaaatatacggacaggaaacagtatgacttcatcaagcggaaactgaatgagacgaaacgctcccgcgacgcttatatcgccgagttcatcgccccgatcaagcggaagctggcagcggcaggattcaagttcgatatcaagggacgtaccaaatccatacattccattaataacaagctgaaaaagcagcaggtggagttcgagggtatctacgatcttttcgctatccggatcgtattggatacgccgctggagaaggaacgctcggaatgctggcaagtctactccatcgtcaccgatatgtaccagcccaacccgaagcgtatgaaggactggatctccatcccgaagagcaacggttacgagagcttgcacatcacggttatggggccgcaaaataaatgggtagaggtgcagatccgtacgaggcggatggatgagatcgccgagcgaggcctagcggcgcattggaaatacaagggcgtgaaagcagagagcgggctagacgagttcttgaataccgtacgtgccgccttggaggccaaggagaataatccgctcgacttgatgcaggatttcaagatggatctatataaggatgagatctacgtcttcacgcctaccggcgagcttatcaagctggccaagggagcgacggtcctcgatttcgcctttgccatccacacgaagctaggaagcaaatgcgtgtcggcgaaagtgaacggtaagaacgttccgatcaaatacaccttgaacaacggcgatagcgtatccgtcatcacgtcgcccgcccaaagcccgaagcgggattggctgaacttcgtcgtcacctccaaggcccgtgtgaagatcaagcaggccttgaaggaggagacggtgaaggccgtggaattcgccaaagagatgttgcagcgccgcttcaagaaccggaagatcgacatggacgagccaaccatgatgcgctatatcaagaagaaaggattcaagaccgtcacggacttctacatcgagatcgccgaggaacgcctcgatcccaaccaagtaatcgacgaatatctggaggctttccgcaaggagacggagacgaacgagcgtaccgaggtgcgtagcgcagaggaattcgtgacgatgactccggtggaggagatatcgacgaacaaggatgtcttggtgatcgacaagaacctgacgggtatcgaatataaactcgccaaatgctgcaacccgatttatggcgacgaggttttcggtttcgtctccacgcagggtatcaagatccaccgtatggattgcccgaacgcccaagagatgttcagccgcttcggttaccggatcatccgcgcgaaatggagcggcaagggagacaatggctatacggttacgttgcgggtgatcggacgagacgatatagcgatcgtcaccaacatcacctccgtgatcggaaaagaatcgaacgtcacgcttcgctccttaaacatcaactcggtagacggattattccaaggtaactttaccgtattggtaagagatacgaccgcgttaaacttgctgacgaaaaagatcaaggcggtaaacggcgtgaaagcggtagagcgattaaattcttagacagtgtactgtgcacgaagtaccgtagtactctgcacgaagtactacagtaccctctaggaagtaccgcagtacttcgtacaggggactgtgccaactgtaagactgggtcttgtgactatacccggatcacagaatcggcttcagccccatcttctccgcacgttgtattaggaactgccgggccgcctcatactcgttcgggatcacgccgtcgaggatggcgttcttgatcgcctctttcagcacgccgacaggcttggagggagccaagccaaacgtctccatgatctcctcgccggataccgggggttggaagttacggacacggtctttttcctctatatcggccagcttctcgcgcaccttacggaagttgttcaagaaacggcgaaccttctccgggttcttgctcgtgatatcggcctcgcacagtttcatcaaatcgtcgatatcatctcccgcgtcaaacagcagacggcggatcgccgaatccgtcacctcatcgtccgacaaggcgatcggacgcatatgcaggcttaccatcttctgcacgtacttcatcttctcgttcatcgggagtttcatcttcctaaaaataccggggatcatccgctcaccgataaaattatgattatggaacgtccatcccaagcgagggtcgaaacgcttcgtggcaggcttggcgatatcgtggaagagggcgctccaacgcagccatagattatcggaagtcttgctcaaacgatccagcaccatcaaggtatgggcgaaattatccttatgcccgatcccctccttggtctccacacctttcaaggcgcaaagctcggggaaaatcaatggcaacagtccgcatttatccagcaagtcgaaaccgatagagggctttggcgagaggacgatcttgttcaactcgtccacgatacgctccttggagatgatggagatacgctcccggttgcggatgatggcgtcgaaggtatcgggatcgataaagaaacctaattgagtggcgaaacgaaccgcgcgcatcatccggagcggatcatcgctgaaagtaacatccgggtctaaaggcgtacggatcgtaagctcgtccatatcctccaacccgccgaagggatcgaccaattctccgtaacgctccttattcaggcaaagggctaaagcgttgatcgtgaaatcgcggcggttctggtcatcctccaaagtgccatcttccacgactggcttacggctgtcatggctgtaggattctttccttgcccccacgaattccagctccagatcgccggctttcacctgcgccgtcccgaaattcttgaagacggaaagataagcgccacgcccgatcttcttggccactcgtttggccaactcgataccgctgcctaccgctaccacgtctatatccttggatgggcggttcaagaaaatatcccgcacatatccgcctattacatatacctcaacacctagctcttccgccgcctccgatatcaaatggaaaggcttcgcggatatatgatttactatctcttcctcgtttatatacatatttatgtattccaaatccaataaagagcgcaaagataatcaaatttcatgtacttttgcggtatcaaatacattgaacgagaaagatatgaaaaagttagcgatctgtataacgctcattgccgccattttaacgggctgtaacggagacgagaaagcggctcaggcccgtttggacaaggcccgggccatgtacgagaataacgagtttttcggggcgaagaacgagatagacagtatccggacgctctatcccaaggaagtaaaggtgctgaagcagggattaacgcttatgcgccaagtagaagtaaaggaggcggagcgaaacatcgctttctgcgacagcttactcccgatcaagctggaggaagtagagggattgaagaaaggcttcgctttcgagaaggattccgtttacgaggaaatcggcaattatatctggaaacagcagacgatcgagcgcaacgtgcaacgttgttacgtacgttgcggcgtgaacgaggagggcgagatgtatctggccagcgtatattacggcggacgccccatcgagcatacgggaatcaagctgagcctgaaagacggccaattcgccgagaccgcttccatcccgtacgacggcggactgaattaccgcttcaaggatatgggaagcaccacggaggtagtgacctacaagggggagcactgcgtcgatgccgtcaagttcatctacgataacgagaaagagcggatcaaggtggaatacacgggaggcaagccttacattatatatatggcggacgccgacaagaaagcgatcgtcaacaccttcaacctcgccaccgtattaagcgatatcaagagcatgaacaccttgaaagagaaatcagagaagaagatcgcttatctaaagaataaactggaggagtagaatccctccatacaaatggcctacctataaaaaagcaccgggatccctaccatacagtaggaatcccggcgttagtatacagactgatatccactatcagttattcatcatttaacgacgaccttctgggcggtctcgccatcaacggaaactaccacgatacctttcgatgccggcatcacgaagttatctgaagaagcgatagcggaagcggtggtctgacctaagatgttagacaatgtaaccgtcttgcctgccgcgttcaagaccgtaacgctagcctcgccagcgattaccgtgaagctggcaacctcatccaattgttcgttggaaaccggagtcggagcattctcgatcgtgaatggaacgccaacattagacattaccacaacattgtttaccacacctacataaggagtcttcaactcgcctgcggccacggtgcgattcagctctttctggttctccaataagtaaccaccatcctgagttgtcttgaaggcgaacaaagcattgttatccaaagacggaacgatattcgccttatcgctgaagcctacacggtagtaagtagcgccattgctaacgaatgtctcgttagaatcccgcaaggataccatatagtagcgaggagaaacagctttggtagttgtctccggcgtatagatcgatgtcgtgatgaaatacaacggtttaccagcgatcacggtatcggcttcttgaacccacaaagagaagttgtcagtctcataagttgacttcaagatatcttggccttcgttcttcacttcggcgaagaaattcagcggattcatcgtcaagaacttgccattcgtaccgaaacgtttgtgagaattgtcaatagaagcgtactccggagcctctacagcgacaaagtcgaagtagttaaccttatcggaaaggatcaggttcgccgtattcacgttcataaagacatattgggtggtcgcacctacagtggtagccatctggtatttgccaccggtcgtagccgtattgaatacgaattccaacggagcggtataatcagataatttcaacggtccgccattctcgctggcaaccaaatcattgctgaaacgttctttcaacatataagtcgcatgatacaaggtatcacctaaagcacgggcacctaaaccatccgttacattctgtacggaatcttggctaaccacgatacgaagagcggctgcgttcgctgcgtcaccggatttaatcatcaatacggaatcagaagtaaacgcatacagatcgtctacgcccggagtaccggagattaagttcaatacatagccattatcggcgagttcctccgcagagaagtgacgagtacccaagaacttatcctttaaatccacattcgcttgatattccaccgtaatagaatcggtgctacccccaaatgtataggtattggccataccttgaacggcgaagatctcctcgttagaaataatagtcgtattcgtattacggtctacaaccgaatacatcccgttgttttccttgatataccactgtcccttcggttgatagatagaaggtttgaaacctgccgcggttaccaacttatcggaagcggcactcttatcgtaagcgacagcgtattgtccgcccttatcgcccttgctcgcactcttcaagaagtatacgcctgtacctgtagcgatcgtagaaggagttcccttcgttacggtaatgacaggagcggctccttgagcaggttgagtagagccggactgcaagtcagatacggtcaaggctttcgtctcgatcacgctggcatatacgacacgtacgttcggaacggaggtcatcggacttgcgttcacggtcggagcggcagcggcatacatagccaaagcatcgttcttcaagttgatcgtgaaatagaatttctggaaatcagcgttacccagtgtatgcaagccactagcgtcataggtggagtcagccgtaaacttagccccatatacaccggtagcaccggcgatcacattcttcaatgtatcgacacctaagtattttgctttaccatcactaaatacttggtcaccttggatttgcaaggtcacatatttagcgttcgcaatagcgcctgtagcgggagccgccgtattcttcgctatcaagttcttaccctcgaagatatttccttgataatttcctccaaacgtcaattgaaagacttggaaaccatcccctagctcacttgcgctcaaatacatagcgtcgctaggagcctctacggtaaatttcgtagaagaagcagaagaacctaagctcaagtctgtcccagctacatccaacgccaagatttgattgtttccgtaataagcctgaatagcgctaccaccggcagcgtcagagaatgtccactgattcacgcccgatgtgataataggctttgccgtagatgaagccgcaaacgacaaaacggcctgtgtcttcttgttcttgaattgatacacaggaccagcaggagtcgtgcccgcattcgtgatttgccacaaggcagaatcaatagcggctttggtagcgtctgacgccaaagttttaacaattaccgagtcggctttctcaccacttaaagacaaaacggaagaacctgtctttaaataataatagttaccggctttccactgagcctccggaacggtcgtactcgactgagcattagccgagaatacgcccgcaaccatcagggccgcagcaataagagtacattttttgtccataatcaaatagattttatttattaatcacagtctaaacaggggttgtttagaaaaggttttgagggggtatgagattaacaatcgatttagcgtcttataacaaaaatcgtcctattctcacgaacaggacgactatactactaaaaatgtaaacagtgtatttatatagtaatatcatgaaactatatattttggagaaaaaccgctccaccttcacaggcaaaacggctggaaatctaatctactcaataaatatcttcacaggcttactcgaaataagcatgttcttttacgacatgacctctgtcatcgaaataaaccttatatatcttaccatttctggaaagtaatactaccttatacttcacaaacgtgctattgtttgacacctcaactgatttcaccatacatccctcataggaagtatttaccgcatcacgcaatacttggggcatatcagttacctcgatcggataaaatttatcctgtgccactgtttccttagcgctaccgaccatcccggcttgcgcttctacatcaggggcaataaataagccacataaagcgacaataaccccgtaaacaatctttttcataccttaaaaacctaaatacctaaaccttttttctcttacatcataaattcgcagtatagggtgcaatctccgtgccaaaactcaccctaaaaaacgacaagagaataataagttgtaaatccgacaattaaccaaaagcgaagaatcaatcattcggttgccaaagtgtggaacaaaccgtggaatgtggaaaatttccccacgagagtgtggaatctctacacactactataaaaaacgaggcccacccttaatctatataaggatgagccttaaatcattctacttaaatataatcaaataaaaatactaaagtaataaaataaagttccgtaatatcgtatacactctgtgtctaatctctaatttgcgattcacaaagataaatctttttgttcaaccatctataaaataaccgcacatctaacgaaactcaaagatttttgaacaaagagattccttttaaggacaagtcatagattatcacgaacttcaatccttcgcttggtgtacggtaagttgcgggaatgggaaaccgatacctacctcattgaaggtcgcgtagatattcttgttaatatcgaaatacacgccccaatagtcggaactgtttacccaaacacgtaccaccacgtttacgctgctgtccgccaaggctgtcaaggcgataaacggagcggccggctcggacaagatgcgggaatccttcgccaatacagactctatcacttgctttactttctcataatcgctgccgtattccacgccaaaagtccagtctacacggcgagtcgtctggttactgaaattagtcacaacgccactgctcaaagagccgttcggtatataaatgaccttattatcaaccgtacctaatacggtatggaacatctggacctctttcacggtaccgccaacgccctgcgcctcaatataatcacccaccttataaggcttgaaaagaaggatgatcaatccaccggcaaagtttgacaggttaccgctcaatgccataccgacagcgacaccggcggaagccaacaaggcggcaaacgacgtagtttgaacgcctaacgcccctacgactgaaataatcaataaaatggttaaactgacattcaccaaactgccgacaaaagtcttgacagaaggatcgatatcccgtttgctcaatatcttccgaaccagtttattaagtaagtttataaccaatcgtcccaccaagaagacaataagggctttaataatcgtaaaacccaattgggagccatgctcaaccaaggatctgatagcttcctctaatttagaactcgcttctacagctgctaataataccatatctcttctattttaattaatctattaattatataacaatctgatcttccaaaatattatgaaatgtagcaaaggtataaagtttttttaatctggtaaaaccatgaaataattacgtagctttgcgatcaatcaaataacacgttaaattcgacagcatgaaaatccttgcgatactcgccgcccttttcctttcaataggctatggccacgctcagacatacgagaagtttgtcgagaaaagttttgacttcttggacaagaacgacttagtctccgccgaagagagcctacgagccgccatgcgcctcgaaccgggaaaccccaacaactacgccttgctcatgaatctcgggacgatacagcgcagacaagggaaactggaagatgcccttctctcctataccgccgccctaagccgccatccgaataatgaggccatactggaaaatcgtgccggcttatatacggaaatgggtgagatagaaaaagcgacgaacgattacaatgccctgttaatcttgaacccccatcatcaagaggcgttatattgcagggcaatgcttcatttacaacataagaactatcttttggccgagcaggatttcgataagatactggaagtaaacgaaaaatccgtgaaaggacgtctgggacacgcgattctcgaaaagctacgggggaattacgatgagagcgaacgcatctttaattacttgatcagcgagatgccccgtgaatggatcttatacgaaggccgtgccgatctatacttcatgatgggcaagaacgcccgggctatggccgatatcaatcgtgttttcgtggaaagtaccccgacagccgctttatatgtattgcgaggcaaagtaaaactcgcccaatatgagaaggcatcggccgccttagacttcaagaaagctgaggatatgggatatgataaaacgactatcgacgagttgatgaagatggctcgttaaggttgtttttatacgtatagtagcatcggctcacgcgagtagtggtattggcctacgccactactcgcgtgagccgatgccactatacgtgtgagcctgcgccactactggtgcgaaatcggcctatttatactacttttccgtgatataattgacaatccaactacccacttctttcgttccatatttcgctccaccttccacttggatttccggcgtacggacattcgcgtcgagggaagcgtctacggcctcacggatcaaggcgccctcttctttgaggtcgaaatactcgaataacatcgctaccgaaaggatttgcgccaaaggattcgctatattcagccctttcgcctgcggccaagagccatgaatcggctcgaaaaccggtgtgctctctccggtagaagcggaaggcagcaagcccatagagccgctgatgcaagaaccctcgtccgtcaagatatcaccaaacgtattctcggttaccattacatcgaagaatttcggctcttggatcatacgcatagcggcgttgtccacatacatatagtctgtcgttacttccggatagctaggagccatctcttgagcgatctggcgccatagacgggaagaggcaagtacgttcgccttgtcaacaaccgtcaggtgcttattccgtttcatcgcatactcgaagcccactttcaagatacgctcgatttccgggcgggtatacatattcgtatcgtatgccttatcgttgtcttgatatttctcaccgaaatacataccaccggtcaactcacggatacataagaaatccgcgccatccaccaattcggcacgcaacggcgatttatgcaataggcatttgaaggtctgcaccggacggatattagcgaacaggcccaacttcttacgcatcgccaaaagaccttgctccgggcgtactttcgctgtcggatcattatcaaacttaggatcgcccacagccgagaaaagaacagcgtcggcatccttacaaatccgataggtctcctccgggaaaggatcgcctaccttatcgatcgcgtcagcgccacaaagggcatactcatagtgaacctcatgtccgaatttctcacaaacggcactcattacttccacgccttgcacggaaatctctggtccgatcccgtctccgggaagtactgctatattcagtttcatcgtaaatgtttgttattattctctgttaaaatgtacatacttaggctccgtggggaaatacgtgtcatcatcccacagggtacttgtaatcatcaagtcggcgctataacggttacaagcgataggtacgttatgaacacggcactgacgaagcaacatctggatgtcggcctcgtgcggttgcggattcaagtcgtctatcaaaaagaccgccaaatcgatctccttacggacaaccatagcggcaatctcagcatcgcctcccatcggaccggaatgcatgcaagcaatatccgcgttcacccctttttcctcgagagctttacgaaccaaatttccggtcgtacccgtacaaacaatatggtggtgagacaagaactcagcgttatgtaccgcccattctaccatttccgccttacgattgtcgtgcgctacaagcgcgatagttaactttttcataccctttacctttttaattattaatcctctatcttgttcagcatcttcaatgtcgccttgatcgccgcctcggtctggtcagcgtccaggccacgagtcttgaaatcgaccccggcataattccagctgatgaccgtctgcacgaacgcatccgtacgtcctcccggcgggatggataccgaatagttcgtcaacatcgggaacgggcggttcaaacgggaataaatccggcgtagggcacgaacgaaagcgtcgtattggccatcaccggaagccgattcctcgtaagcctcgccattgatctcgatcttcaaggtagccaccggtttcagcccttgggccaaggataaggaatagttcaagatccggattttctgatcctccagcgcattatcatgatgaagcacatcgctgataatataaggaagatcctccggggtaaccatttctttcttatcccctaactcaatgatccgttccgtaaccttacgcatcgaaccctcgtccatgtcgataccgagcgcttccagatttttgcggatattcgcttttccggaggtcttgcccaaggcgtactcgcgaacccgtccgaaacgctcgggaagcaagtcgttgcaatacaggttattcttgctatcaccgtctgcgtgaacaccggcgcactgcgtaaacacatgctctccgataatcggcttattgggcgggatatgcacccccgaataggtctctaccaaacgactggccttgtttatcttttcctctctcaagctcgtctcctctcccaactggtccttgataacggcaagtacgctgctcaagggagcgttacccgcacgctctcccaaaccgtttacggtcgtatggattcccttgatacccgcacggatggcggaatatacattcgctacggcaagatcatagtcgttatgtgcatggaagtcaaactgtaaatccgggtagcggtccaccatcatcttgcaatactcgtaggtatttccgggattcaagactcccaaggtatccgggagcatgaaacggcagatcggaagtcctttcaacgcatcgattaccaagaatacgtaatccggggaatgcttgataccgttcgaccagtcctccaaatagatattcacgtcgatcttccgtttcgccgcttccaatacgaccgtacgaatatcgtcaacgtgttgctcgggagtctttcgaagctgttcggtgacatgcttataagagcccttgcaaagcaagttcacgacacggcaacctgcggattcaatccagtcgagagagaccgtaccatccacgaaacccaagacctccaatttgtctaggtttccggaacgggcggcccaagcggctacacgcttcacggcctcaaactctccgtccgacacacgggcggaggcgatctccacccggttcacgcctaagtcgctcagcagcacttgcgctatgctaagcttctcgtgagcggcgaaggagacgcccgaagtttgctccccatctctgagggttgtatccattatttctatcataatcagcgtgctgcctcgaaggcttctatctttgatttatttgccagtaaatagtcgatatcgtccaatccgttgatcaggcaatcttttttataggcgttgatctcgaaatgctcgctcttgcccgtagccttgttcgtgatcgtttgctccggtagatttacctcgacctccgttttcgggttcttgtaaatcgaatcgaacaattcagcgaggaactcctctgtcacaacaaccggcagcacgaagttgttcaactcgttgttcttatggatatcggcgaagaaactggagaccacgacacggaaaccgtaatcggcgatcgcccaagccgcatgctcacggctggaaccggaaccgaagttctttcccgctaccaatatctttccgctatacgtaggatcgttcaagacgaatgattcgatcttattaccttccttatcatatcgccaatcccggaataagttctcgccgaacccttccttggtagtcgctttcagaaagcgggctgggataatctggtcggtatccacgttctctaaaggaagaggcacgcaagtgcttgtgattatattgaattttgttttcatcttatgctactttattagattagtctttacatcagttctctcgggtccgtgatcttacctgtcacagcggcggcggcggccacaagcggccccgctaagatggtgcgcgcacccggtccttggcggccctcgaaattacggttggaagtggagaccgcatatttacccgccggaaccttatcctcattcatcgccagacaagcggaacatcccggttgacgaaggacgaagccggcctcggccaaaaccttgtcgatcccctcggcacgaatctcccgctctacctgccaactgccgggaaccagccaaaccgttacatcatccgctttcttctttcctttcaccaaagaggcgaaagcacggaaatcctcgatacggccattcgtgcagctgcctaaaaagacataatccaccttctttcccaacatagactcaccagccttgaagcccatataatccaaagacttcttataagagatacggcctgcctcgggcacgctttctaaagagggaatatctttgctgatactcatacccatgcccgggttcgtaccgtacgtaaccatcgggtcgatatcctcggcgtgaaaaacgatctccttatcgaacttagcgtccggatcactatatagctgacgccactcgctcaccttccgctcccattcctcgcctcttggggcaaactcacggtctttcaaataatcgaaagtaacatcatccggagcgatcataccgccacgggcacccatctcgatagaaaggttacagatcgtcagacgttcctccatggtcgtattacgaatcgcctcgccagcatactctacgaaatagcccgtagcaccgctggtactcatcttactaataatgtataaagcaaagtccttcgccgtaacgcccggtttgcgtacaccatcgatcgtgatacgcatcgttttcggcttacgctgcatgatacattgggtagccaaggtcatctccacctcgctcgtaccgataccgaaggcgatagcgcccatggcaccgtgcgtagaagtatgggagtcgccacaaacgatcgtcatacccggctgcgtcaagcctgtctccggacctaccacatggatgataccattcttcggatgttgaagaccgtaatacgtcaagccgaaatacttcgcgttctcttccaaggtatccacttgattcttggatatagggtcctcgataggcttatcttggttcaatgtcgggatattgtgatccggcatacaagtgatttgctcgggacggaagggcttcaatccacgtgcacgtaatccggcgaaagcctgcgggctagtcacctcatgacaatacagacggtcgatatacaattgtatggttccgtcgggcaacgtgtccaccacgtgtttgtcccagattttctcaaataatgtcttgctcattgtcttgtctatttttagtctactataaacttattgatggcgtccacgaaagcctccacggaagcggcgataatatcggtattcgcggagaacccgtaataggtagccccgttatactctacctgcatatgcaccttgcccgtatcatcgctacctttattaatggcttggatcaagaattcctgaatcgtcatgtcactattactaatggcttttttcaccgccttgatgcccgcgtcaaccggaccgttaccagccgcggcctcatatcttcttactcccgacaaatttaaacaaatactcgctacggattgtactccgacaccactagttacctgtaaatattccaatttaatacggtgggtggccgtacgatcctttccgaccaacatcaaaacatcatcatcattaatatctttcttacgatcggccagtttcaagaactcatcgtacaccttgtccaatttctcctgctccagatccacacctaaaacatgcaggcgatgcttcaacgccgcacgaccgctacgggctgtcaatacgatcgcgttatcatcgatacccacatccttcggatcgatgatctcgtaggtttgcgcattcttcaaaacgccatcttgatggataccggaggagtgagcgaacgcattacgtccgacaatagccttattcggttgtaccggcatattcatcaagctagaaaccatacggctcgtactatagatcttattcgtcgtgatattggtgatgatatcacgttctttatggctcttgaaaaccatggcgacttcttccaatgacgtgttacccgcacgctcaccgataccgtttatggttacctccacctgacgggctccgttcaacacgccttgtacggtattcgcggtagccatacccaagtcattatggcaatgggtggacaagatcgcattatgtacgccatccacatgttccatcagatacttaatcttcgccccgtactcatccggcaagcaatatcctgtcgtatccgggatattcactacggtagccccggccttgatcacggcctccacgacacgggctagatattcattatccgtacgcccggcatcctcacagtagaattctacgtcctccacgtactttttagcgtatttcgtggcggcgatcgcacgctctataatctcctctctcgtggagttaaacttgtatttgatatgagaatcagaagtaccgatacccgtatgaatacgtcctcgcttagcgaatttcaacgcctcagctgccacgtcgatatctttctccaccgcacgggtcaaggcacagatggtcggccaagtcacggcctttgagatctcaaccacactcttaaaatccccgggactggagacagggaaaccagcctcgatcacatcaacacctagctgttccaacgccttagctacttgaatcttttccactgtattcaactggcatcccggaacctgttcaccatcacgtaaggtggtgtcgaaaataaataatctgtctgacataatcttatattcttaatttactaatatcctatactaactaaaaaagcctctctcacaaggaagtgagaaaggctctttcatatatcgtaatgcccgcgaagcatacagtctcacttcctatcccgttcccagagtagaataatgtttagagaaataatgagactattttgtaagttgcgtgtcattgttcttgtctttattgtttttgttcttgttttaacgctgcaaagatacagcctttttcgacaccaccaaatataattcgaagttttttgcaggatatttcttataaaacgtaagataaacattcgcatctgttactaaataacactgcccatcgttaggtcgtaacgatgggcagtataagcagctcacaatgcccattgtaaagtctttatgatgggcatcgtaagcagtagagacggggcgtgccccgtctcctcaaaagagtaattcaagattaccctaataaagaatcacacaaaagcgatcctgtcccgattaattccgtatatttgccaaagtactaattaatacaattacaactatgactaaattaagtaacatcccaaccaaaggagtcacagccaaggccacaagaacacgcaaagccaaaaccgaatccaccaagctcgtctgggacccgaccaagcctatccaattcacccaagaggagatctgggagcatatccatgagatcgagaagggaccgttcatgacccttgatgaatgttttaaccgtttcgataaatggaagcaagagtttctcaaaagcaggttatagccagtagccaattttgggaaagctatacgaatatatatactcaagacctgacttatttggtttctaccaagcggaattatacaccaataagaataagataaaatccattttatatgagttagaccggacgtatccttattatcctgaatgccgccacctagctaccaaaagccgtatgtaccgaaacatcatcttgaagtaccttagaaaataacagtaaaatctgtgaagtaaatttaggcatagtcatttggatatccgtagttataaagtaagttggcttcatcggcaaagtaagttaacttacttaggcattccagctagttaactttgttgatgaagctagcttcactaatttaatctcaccttcgtcgtatgaagggggatgttccctgtattgaggtaaaatgtgcttgttgatcctaccaattttatatgttggtggagctcggtgctgctcagatgagagctttagcaattcgttacccattatttaggccgtaagtctagcactaggtatagccataagtttacggctcgacaaaccgtaagttattcactttaatggggcttgatggataacaatcgggccgatatttttttaataccgggtgaacgaaaataatagtttattcatatattctcacttcataataatccacgtttcacgggaatctgtttattttaggattatcacaaacgtgaaacgtggataaaagtaagttagaataggctatccttgggagcgataagccccaatttttctagtaacgaacggaatcttgccttaatgcgtgccttcatggggatatgcctaataaagcttttatctaagccggatatgtttaaatagaaagcgaaatcttttttgaaaggaggctcaaactcaataaaccaaggtttgcttccgctataatgcaagataacagggtcattgatggcttgctctttttcatcccaataggctcggctaatcaacgggtccttgaaaaaatatccgtgttgtacattgtatttcaaggggagggttagcttgatctcttttaatactatattcaatacatcttgatcatggtatctaagtctctctgggtatttgttgattatctcgaaaaagctttctgaaagattattttctcgccaatatcttaggttgaccaacaataccccagcgttgaaatagccaagagatggggaatattggagccggttgtaaatacgtatgtcatctattgacatgtcggggattactccggcggcatagctttttatatccgtatcccataatgagcgtagtgagtggcggacgacaacatcacagtcgagataaaggaccttctcaacgcttttgggaagtatatccgtcatgataagtctaaaataggtcgctaacgtgatatgtctacttatcgggcagttggcgaaaacctttttatctacagtatagaactggatttgctggccatatttggctacgacctttttcaatacctcttggttttcaggggatattccctctgtcaagatatgtaccgtaatctcctctttcgggttattcacacaaatagaggttactaatacaccacagggtatgacataattattgtctgtgcaacatacaatatccataggatgtgttttttattcaagttaatactgtgtttctactgtctatgtttttttaggatcaacgagagaatgaaatctatctcttcccatttaagcaaataggatagagttagataatagcagatacctataattataccgacaatgagtttaaataataagatagggataaaacttacgcaaatgtatatgattagtcccatcgatatggataacaagagtataggacataaagccttaagctcttttcgcaggtaaacatcgggtaaaagtcttttagtgaatcttgtcaatacatagatgtcacataaggcataagcagcgataccggcgcacatgatggtgatcccaaatggaatggtaatgactaagatagtaaccgcaatgagcttttttatgatctcggatcgcagggaataatcacttctccgttttacgttgagcagatcccagttcaggcgtgagatcgggtcccacatataagcgatacttaatatttgtaaatatggtacggtatgtacccacttatctgtcaagataacacgaattaatggatcagccaatacgcataagccgatcatcaatgggaatatgatgaaggctgtcatacggatgaacatgaagaactttcgttgcagttcctcgttatcatgctgtatttggcattctatcggataagtgacccgtgtgatgatgcttgttatattaacggaaacgtattgggcaagagaagtagccctgttgaagtttcccagatcagcggatgaaaaatatttaccaattaccaatgagtatagattcagatatatcgtatgaagcaatcctccggcaagtaatttagatccgaatccgaacaattccttgaaagactctttggagaaacataggcgaggaatccaccgggtacttccccaaagtaatatcaaagctaataaattcgtgagtaaactttggatgaccagtgtccatacaccataaccatgataagccagccatatacctattcctccacttatagctactgtgctgaatgagatgatagcttgctttttgaaatcgagggaaatggtcagttgtgctcgttgtacggcgcagaatgaggtcaagattaagtttaatcctacgaattttatgatggtttctagttgaggctggctgtagaatgaggctatgaatggagcggtggagaaaaggagaaggtacatggctatcccgataaatatattgaaaaagaataccgtcgaatagtctacatctgttcttccctgtttctggataagagcgttcgagaagccactatcaacgaacgtttgagctaccgccatgaaaataccaagcatggcgacaagcccatagtcggaaggcgacaagatacgagcgatgaaaagacttaacacgaattgagctccctgtaccgaaatcctttccatgctactccaaaaaagaccgtttactgttttgcttgccatgtattattcgggttgtttttgagaggttgatttattagccaacaattggtgcttttgctcagacattacaagccctaacaacatcattataaagaaaccccgatgtccggtaaacgtggcatctgcgatattctcaatcaatagatacccgatgataagaaaaggtataataaaatatttctccttttgcgtagagagaaatagtttgtaggctttccgtatgatataggcgaaaaatagtatatataagaatacgcctattatcccaaattgagctaaacagggataataggtgtccgctatataactataattgtttttactgatcccttttacattctcgataccgtattttgcgtatagaggcgaataataaacgccagaggagtgggaggcaaaactagcgaagcccgacccaaatgggaaaaagtccttgaaaatctcgaaagatgtgacgtatagcatggcacgggccatgaattcctcgggaacactgtccaaggatttacccacaccaaagtacatgaccatttttttccagctagctaaaaccattgcggcaagacttaatacggctatcgctattgtcttgaaattgagcttcagacgacttatgttcccgaagaatatcacggtgaccagagatatgataaaaaatccatagaactttgaacgagccgagaataatccaatcgctaaaataaggataaagatcatcttatcaattttagcaccttcgctacaataataataaagcagggaggatgcggttatgatagcggcgaaataagcgacatgcccaacagttactctgaaggcgagtggatagactagagacgcacatcctataagaaacatgaaaaaggatataataagaatgattttttttatcaaatctttctgtttcgaactaaatacaggacagagataataaactgcgaaaaaagctaaatagggtttaaattggataatcatgtctgagatgattcctttcgcagagttactatgtatataaaacgaataaatcgtataaaatatgaaaacagagcttaccgctagaaatgacttatttatagcccaatccggcgtcttgaatgttgcgaaaataaataagataagcaagatgcaagcacatatctcatctatactatcaaatccgatcgttccataaaggaccaatccaaatatgaacgtgaaaataaataagttataaaattgcttgtttatgaattcttgtatcatcttttttatttgctaggaacgacctttggttgtaactgaaatgtttctttttctctttgaggtgcacttgtgaggtgctgagcctcagatttgatcttaaatctgtttttcctaaagaaataaaagaaacttttcaaatgaattaacgttttcttattaagacgctgactacttctttggtgaacatgcgtcattttggataaagggtaatagactaccttcttattctttttccaacaacgatagcaaatatccatatcttctacatacaagaagaatttctcgtcaaatccttttagttcattgtagaatgtgtgagagatcaaaaacgctgctcccatacaccaatcgacctctgtaggagtgtccataggaaggttcttcagtaaataggtttgaacatttttattgccggacttatcatttcctttggtaagagcccgatttagcaaaatcttaattgaaggaaatctacgtgcagaatattgcaatgagcagtcccggttttgtaacttgggtgcgacaattccacatgaaggatgttttatcgcatagttgtataatttgtcgattgctccttgcgttaatatgatgtctgggtttaatataagtatataattccctatagcatgttttgctccaatattattatttcgggcaaaaccatatttcttttgattctcaatgagttttatggtaggataattgttccggatataatcggcggttccgtcagtagaacaattatcaacaaaaataacctcgaatgaaacggatggacttcctactgaatacaaagacgcaagcatctctttcacgtatgaaaggtgattcatgccaactgttataatcgatatttctggtttcattatcattttgtcctattatgtttttaattttatagatgcaatttatgttctatttgttgatgatagattgtatttttcacctattataacattattaagtttgttggtcgggttattaccttaaaccgattcttctttaaaaagtaaatcgtaccatcagatgagcaattatctacgatgatgacttcgagcgggactgatggccttcctgtcgtgaacaacgaatttagtatctccatgatatatttgaaatgattccttgttatggttataatagatacataaggtgtcataaactagtatatgcgttttgataagacaaagacattttcttcgctgtataatgcttttggaatatgtcttgtacttctcgtgcgacttctgtacgatctaacaggagcactttttctattttgtcgaataaactattactgtctttattgttgaaaatatatcctgtcgtgacgctcatcttcgatagcacctcttggtgtgaaggtatatcagaaagtaacataggtaatcctactgtcatactctccaacagcgtgtttgccaatccttcgacatctgaggctgaaatataataatcggaagcgattaagtaatcataaacattcgttttaaaaccgggtaaaagaatccggtcatcaccttctttttttaaatcttcccataagggtccctcaccgagcatgatcaatcccacttgcttggcccctatttgtttaaaggcacgtattaatagttcaggattcttctctcctgagaagcgcccgataaaaataaaatatcggatatcgtcttttagtcctaaatcttttcttagcttttgccgataaatcggatcgcaattccagatgggtaacgaagatccattgggtatgcaagagatgtcccaacctttattttctttatagagttttcctacactttcagagcaacctatggggagatctacttttcgggtgaagaaatggttcagttgattgacgatatctcctttaaattttccatataatatctgctgctgcagtcccggatagatatgaatcgtatagattcgtttatactttcgaggtaaaaagcacattaaatataatgaacgcggacaatgcgcatgaagcatatccggattgatcaattttacctcttgttttagtgccgtgaataaagcgaatggattaagaggcgtttctggtgccaattgatgaatcgaaagcggatacttctggaaatccttaattcgggtagtttttttctctggtatgaaagtaatgatagataccttgaacttggagaagtccatatattggataatgttatacataacattaaccgggccttcgttgcataatgatgataccaagaaacaaactttagtcatgctctcttccttatttttctttactgtcaaactgtacctgcaataataacggacgggtgaatctattattgttgatttctccgtttgtttaacaatgtaagatttccctctattaaagggaaaccgaatacaaagttaacagttatttctttaaaaacagacgaacatatgatttttttcaatttgtatatttatgatagcggatttctatgaattattgtacatttgcatacgtttttaagatattttgagaaataaagggaattatgaaaatagcaatagttggaacaggctatgtaggcttggtaacaggtacgtgttttgcggaaatgggtacagaggtgttttgtgtagatgtggataaaaataagatcgataatctgaagaaaggcatcgttcccatttatgagccgggtttggatgaattggtggctcgtaatatgcaggcggggcgtttgcattttactaccgagttaaaagaatgtctggatgaggtggaagtcttgttttccgcagtggggacgcctccagatgaggatggaagcgcggatttgaaatatgtgttggaggttgctcggaccgtgggaagatacatgaataaatatatcttggttgttactaaaagtacggttccagtaggtactgcccagaaggtaaagcgagctattaaggatgagcaagctaagcggaatgtaaatatagagttcgatattgcttctaacccagagttcttgaaggaaggggctgcggtaaaggattttatgagtccggaccgtgtagttgtaggagtggaatccgagcgtgccgagaaattgatgtcaaagttatatcgtccgtttttactgaataatttccgggtgatttttatggatgtcccttctgctgaaatgactaaatatgcggcaaacgctatgttggcgactcgtatcagttttatgaatgatatcgctaatttgtgtgagattgtcggtgctgacgtaaatatggtgcgtaaagggattgggacggatgctcgtatcggtagtcgttttctgtatgcgggttgtggatacggaggttcttgtttcccgaaagatgtcaaagcgcttgtgaagactgctgccgatagtggttatcagatgcgtatattggaagcggtagaggctgtaaatgaagagcagaagtcaatattgtttcgtaagttagtgaagcattttaacggggatatcaaaggtaagcgtatcgctttatgggggttggcgtttaagccggagacagatgatatgcgagaggctccttcattggttttgatcgaaaagttaagaaacgccggatgtctggtttcggcttatgatccagtggctatacctgaggctcaaagacgtttgcctgaagatgtgatttcttatgttaaagatatatatgaggctgtgatagatgcggatgcactattgttggttactgaatggaaagaattccgtatgccttcttggtctgttattaagaaattaatggctacgcctttaatcttggatggacgtaatatctatgataaggcagaattggaggaggccggttttatttatcattgcataggtcggtaaagaccttttggttggaaataagttatggggctgtgttgcaattctttgcttgacacaacccaattgtctatttcatcaattctttctttaacgaacacccactacatccgcaacaagggtctttggatttgggggcggcgaacattcgataaaccttatatgcgatatatccgataatcgagataccaataacgcaaactgctatatcttgccacatacctataaatttaccttctaatataactaaataagacataggaaagttcttagcaaaataaacccacaaagaaattccccgtttgataaacaatgaaagaaacgatccatgctaggacacaagtataaatgataacgaatataccccatttccatgagccagactcgttgacaatagccgatatagttgctatgcacggaaaataaatcaagacgaaaagcattaagctaatcgctatgagcggtgtgaataccaaattaccttctgcgttacggtcttgcttcaaacgctccgacagggcttggctgtcatcatcggcattccccgtgtataatacgcttaacgtgctgacaacaacttctttcgccgccataccggtaagtaggcttacactcattttccaatcgaatcctaaaggagccaagatcggttgaatcgtctggccgatacgcccgatatacgaattttgttggtggtcgattgccttcaagcgttctaactcctctatcgtatctgttttttcttgagaatccaactccgtattttcgatctccgctatctggcgatcaaactgatctccgctctccgaatgtctggggaaatacccaaggaaccagatgatgatagaagcgaccaagatgatacctcccatcttgtgcaagtattgtttcgctttctcccacatatggatcatgatggatttgccggtaggcatccgatagggggggagttccattacgaaaggaacatcctcctcgttaaacaggaagcgtttgaaaagacgggccatgataactgccagcaagattccggatacatataaagctaataacacaaagctggcgttcttcgggaaaaacgccccggtcagcaatacataaactggcaggcgggcgctacagctcatcaacggatttaccaacatcgttatcatccggctattacggctctctatcgtacgggaggccatgatagcaggaacattacaaccgaatcccatcactaaagggatgaacgactttccatgcagtcccatcttatgcatgatcttatccatgataaaagccgcacgtgccatatatccggagtcttccatgaacgatatgaacatatacagaatcaagatattcggcaggaacacgataacacctcccacgccaccgatgataccatccacgagaagatccttcaaaggtccttccgacatatggctgcgcacgaaattaccgatcacttcgaccaatgcctctatccattccatcggatagcctcccaaacggaaagtggcctcgaacatgatccacatgaataggataaagatagggaagcctaagactttatgcgtgacgaatagatcgatgatctgcgtactcgttgcctctttgatcgtattttgttcgtaagtctcacgcaacgctccggaaataaagccatagcgtgcgttcgtgaatgcggtctcacaatcctcttgcaataacttttctattagggctgtattacggtctctttcttggaagatcgtttcggcaccgggcagcgtttttataaatgtctctatctcccggtctccctctaatagcttgatagatagatagcgctttgacaagcttttgggtatatccacgctatttttcaaggtcttcctaacgttgctgatccctttctctaaagactctccgtaattaatatggatatgacggatgacaggatcttcttcttcgtataccttgattacacggttaaacaaatcctctatgccaaagcctgttttacttacggtcgggataatcggtgccccgatcatttttgctaaggactcatgatcgaatttattaccatggcgttccagctcatcatacatgtttaaggcgattaccatgcgaacgtccatatcgatcagttgggcggtcaaatataggtttcgctccagattggatgcgtcgataacattgatcaccacgtctggttgctcttcattcaaatgcttacgcacgtataattcttccggcgtgtaagcggatagggagtaagtacccggtaaatctacgatgcggaatgtatagccattctgttggaaggttccttccttggcatctacggtcacgccgctatagttacccacatgctcatgtgctccggatgcgaaattgaaaagagaggtctttccgcagttcggattaccaaccaaggctacgttaattgtttttcctttatgtaatgcgatggcttgcaattcattgccgggaggcaggataaaagagtctgcactcctgttcgtatcttgtaccgaggtagcttgttccttctcgaaatccgccgcgctaacgacttcgatcaatgcggcgtccgagcgtcgcaatgagacatcatatcccattacacgatagtgaatagggtctttgagcggagcgttttgtataacgatcacttctttccctctgataaatcccatctcgataatgcgtttgcggaaagctccgcgacccattacctttactataacacctttatcgcctgtgcgaagttctgataatctcatgtcctattaaatgttacgcaaaggtagcttgaaaacttcgtaccaccaataccaactaataggtatttttttatttccatgggttgtttttcgagtattttatgtatgtttgtgccacaaatttcaactttagacaaatgaaactacgaattactttgttcgctaccttattggttcttctgtctgcttgttttacaggctgtaaaaaagaattgaaggatttctcttttagttatagtatggaaagtgtagataactacaaactaatggttctgtttgatagtgacaagacattccgtatcgaggagtataattattatatggataatttcgccaagaaacgagatcctaaaattatggaggggacattgactgacgaggagtttgcttctttaaaaccgattctgcaaaaatgtaatttctttaagatgaaagactcttatggctttgaggaggagacgaaccgggatttaggagatatcatgtatcaggtttcatttactacggaaggtaaggagaaatttatctctatccgtaatagcgataccggacaattttccgcttctttcgtgaagttgatcggttttatcaatacattcttgaataatcataaaaatgactaaacgcttttagccggagatggagaataaacgaaaccgggttctattgtgcttaggctctaattgggataaagagaaaaatatggagcgcgcggcggagatgctgcgtgctcattttgtttttatacagttttctcagccagtttatacggaaccgatcgattgtccattatcaactacatttttgaatcgagtggctgttttgtatagcgaggagagtccggcgcgaataaaggatgtcttgaaagatatagaatgctgcatcggccgtaagccagaagataaatcttgtggacgtgtgccgatagatattgatttattgcagtggaacgaccaaatcttgaaagctgaggacttgacccgtgaatatgttctagatggcatctgctcgctccttgccgcaggagagaatgatgaatggtgccaatagaaaaccaaaggagccgctgttgcggatcaatgcgttgatacctttgcatatcaaagaaagaactgggttgcttcggtctgcgttataaaatcctttctctactttaagcttgaactggtagggtgccaataagtcctcataagtctgtatgggaaggattcgttcggcccaattacctgtagccggatcgcaagtattgtatgggtcttccggacttggtaaactctttttctcgatcgctttttggatatcgggataggtcaagcctctagtctgccgagcccatgtctctacttcttttggggagaaagccgggcaaagtttcgttatgaattgctctcgtaatgtataatagttgggggattccaaagatccactttcgcatccgaccatcatcttatgtaaccgttgttggacatacgggttgaatggtgtagaggctgtcgtgaatagtagatacatggaatcgtttatatggattaaatccttgaagaacaaagataaatcatagacatgctctatcaggtccgtagcgattaaaagttgggggcagactttgttccttgcgcaccagtccgcaagaacatctgaatctccatggagtatgatatcggggcctattcctattatttgtttcaatagctggatcgtctccacggaagatgggttaagatcaatataaataacttgtcctattcctatggatttcgccagaatactaaggaagccggttcctcctccataatcgattagcgtgacatcggagataggggtttgtatcgcttgaagtcctctttgcaggcaatctgcgtatatatgcatgaaatagcttaacgccggctttaagttgccgatgtatcgtttattataatcgctgatcggtaatttattatagtcgatcgctttcaaacgttcggttaatgtatgtaataaatcacttctattctctttcatcatatatcatcttgtataaacgtatcccctgatcttcattagaaaaagcagggaacaataattgttttcgtttatctatcacctctttatctataggtagggccattaattgttcgcaagcccgtatcatctcatccggcgtatcggcgatatggcataaaggatctaatccgctacccgctagcatgagatgattgacaatcgtatgccttccggcgaataagctgttcaaaagctttagttttaggccggtatcttgaaatgtgattagcatatgaatttgtgcgttgtggatcaatgcgtccatacgttccttactgggatttgcttctacttttatatgtgggtaaggagcggctgcctctcgtatcaaacgggtcgggttcatgcccgctattatgcaggtatgttttaattggctgaaaacatgcttggtgagaaataacacggctcgttcattctcgataacggataacttgccatgatataaaatataatcggattttcccggttcggccgtaatccggttattctcgtggaaacaaggaacgaactcgatcctttgattgggaaattgttttcgtaaatagtctgcgtctgtcgtggatacggcgattatcagatttgcgtaccgtgctactttctgataggcttggaagcgcatggcctcgatcttgaaaaaggcattgcgaaccaatcctttgccagactttgccaagtggcgataataatcgtgctcgatattgcactcccggaatatcttcatccggtttcttaaacggggatcgtccatataatagcaggagtggaggccctcaaataagatcgggtaatcattttgtaaaagattctcgatcaagcgatgatctttacggctatatacattgtaagggagccatgttaaattagcgattaccccggtacggcgtttataatagaaaaccttgtcgcaaatgctttctaattccggcgcgtgcggacgttcatattcgaaacaatgtaatatgagtttcacgccgcaagcacgcaaggcttccagtttataatacacatcaataacccctccgtaattggcgggataaggtatattgaacgatactatgttgaggtatttatccatctgcttaaatttcctcaaatatacgcgcaaattggctagcttgttctttccgggaataattcgatagcttatcccgattgacgggcgaggtcgtatatcctttttcctgccattcctcatagtaatgtttcaagaaatcgtacacctcgtctacccgggttgcggccagtccggaatgggtctccttgatggcttcggcgaggtaggcctcgtcactttgtacgcataagatgggtttttctaccgcaagcgattcaaagaacttagttgtcatgaagccttttggaccagacgtgtcaaacttattcgtcaaggaaagcagcaccgagcttttgttcaagatgaggggaatatcggatgccggtacatactcatggtaatccatgaaagattgcaccccatgtcgttcggcctcttggcggatgatggagcgggactcttgatcggtataccatacaactcgaaaagtttcggggataatgaccttgtcctccgtaagacgggcgatggctgcaaataataactccggatttcggatcgctaaacttaacaaccgtccggtataggtaatgataaaccgggaggtcttgatttgttgcggatagaacaactcaggatcgaatccgttataaatcagtcttacgttgggattatactgtttgagtacctccacatgccaaggcgatacagtcgtgacacaatccgctacctccaaagcgttattccgctttttaagtaaccgtttgcgaaatcgctttgtgatgaatgcgtctaaccatgaaaatgtatggaatttatgcgatatatattcgttggaggcgtattgctcgataatatctcgtaaatccacgacgaaagggaggttggtatggatcgctaacgtcttggcagcggttaaaggaaaggtgcggtatgtgctacacaatattcctttgtactggttggtctttattaagggaatacatgcgttgattattctcatgtctttataaccaaacaagatgtctagaaacatgacccacatccattcgatatgctttgagatctttcctgatgctttgtagtagcggacgcaatacacgtccgcataccctgtaaggaattcgaatgtattgtcttctatgtattctgtcactacggtaacttcccatcccatgcgtgtcaaatatttgcatagatatcccattctgggggcgaaagcgggtgggaacatatcacatatgataaggagtttattcatggattcaatcagtgttataagaatagacgaacgacttcaaacgcttccgcataggtacatcccgcttggacaccccgtgctctcgctaatgaatagataaagtccttggatagataatctctcgctccttgcgatttataggctttcaatgattctacctttgcgtcgatatggcgctcttccagccttacaaaacattgtgtattgaatgtcaagttgttccagattaactcataacctaatatattcgtgtttttgaacgcccgtagaccctcttgggcgatcgtcgtatgatcttggtggatgtcgtgcaagctagggatgaagactaggtcaaaatcggatacttttttcaggcgtattaactcctctaatatctcttgtcttgcgtatcccagttttcttacttcgtaattgtatatgattaggttttccggttctatacctaaggtctgggtcgcttgcttgacctctgtcttcaagatatctttcggaaaaccctcgggaaccgattgctgtgcggtggagaaagccacataggtcacttttttaccatcttctatcaggcgtgagatagttccccccaacccaagttccccatcatccgtatgaggggcgaggactaaaatatttttacaattagtaatcattctttctgatttatttgaatacagggattttattgttttcactgcttcgctaattcttttaatagctgggcgtataatttacgtaaataacttccggacccttcttgtacggagtcattatgccatagtaaaaccaattcacctcctacattatttacttgttccactaaattccggcaataggttaaagccctgtcaaaatccagtcccatatatttctcctcctctagggtacaatccattataataagcggatgtagtcggagaggagatagccggcgggtgatcggattgatccaacgaaccgggtagcaagtccctaaccggaatccggagacatcggcgtaccccatggtgaaatcgtccgtaaccccagcagcctctatttggtccatatcttccggttcccggattgccaagaaatgatgacggttgaaccgaacatttttaccgatatgatcttccagaccggttttctctttccggataaggctgggagtcgtacccgcttggtagctactatgcaaaccaatagttacattatgctctaaagcactttttatcaatttacgaatatctttattcctcaaatcgtaatgaggtttgtcgtgcttggctttccccccgttccggataaataggataaggtgacattgttccttcccgatcaagtcctgaaggatactattctggcggaaaaaccaagggaaggtataaaacgggtctttctcaagggaaccgaatttaccttgaaaggatttatataaacctcttctatctctaatagaccgtatcaaacctttccacgaacgatatagagtcggagaatctacgtcgtgcgtgaggtagatcttccggatttgcttttttacctcgggtacacgtaaccgggattggcgcagccaacgatgaagcagcatgcgatattcatccacgatcggacgatgcaggaaaccggcccggtagggcaaggactctttaccgggaaatcttccatgctcatcccgaagtccacgccgtaccatctcctcgtatctggaaatgagaaaataagtacttgcgatgatatcggcatgaaccacccatgtatctcttatccattcctctttcggcgagccgaataacaaggggataccttgaacctcttgcaaggggagtgccggtaaggaagcgggagtcccgtatgtttgtccatcaaagaagccggatggaatgataacgacgttatatcggtcgaatttattgggatcagccgtgtacccgatcgtttccaccagttcgctagggacatcatctcctacaagaaaacgtattatataatgtaaagtgcgatttttcatacccatttgcttagtttaatgcgtgctctgtctaataaactcaatttccccctagatattgtgaaaaatggggtttggatagctccgaactcgcggaagaaacgttctactccgggtagcatagacccttcgaaatcaaataccgtcgtaaattgagaaacgaaatgaagacattcccacaggacgtagctttgcgctccggaacctctataggccggatttcctcctcctgcgagatagtaagccgatcgatcttgccatacgatgaaagcggccgcatgtaaatggccttgctcgtcataacctccccataaatcaccttgtcctctttgccggcaagtggcgatcaagtctttcagtacattcgtgtcttccttgattcgtacatgctggcgatcaaatgtttgggcttgtacagctaggaactcattcaaaggaatccctttttttacggatatatggtatttattctgcgctttcgcaatatttcgccggatattggggctcatattctcccataccgcttgatgatcccggatattttttaataaataggtataacgtgtcgtttggttatatcccgcccaataaaacggaagccaatccgtaatgtcataattgaaattttgcaggaagtgcggatagcgttttagttcttccgtgaattgtttgcatagttcttgacgtcgtcctaactcggtcgtatatttcgtgtcggaggaacttgcggcgaaccaagggcccatcgtttgggtgtaagaaggcattgagacaatatcggaatgggggacgtaaagggggagggttgcctgtatccttcccttttgttctataagcaagacatcccattttttttctccgcaaaccgtatccaaccaccagtcatgtgagaagatcggtatatttttttcagtattgcaaagtaaacgatatttgtctttattactcattacaattttgtataggggcggggtttgcccgcccccgcaaattacttgttggcttttaatgcctcaaatattaattcggataattcgtctgccaattcgggattgtcctcgacacattgttttgccgcatcacgaccctgtcccaatttggtatcattgtagctgtaccatgaaccgctcttcttgatgatattcagttcagaaccaagatcgatgatctctccggaacgggagataccttgaccgaacatgatatcgaactctgccttgcggaatggaggagccaccttgttttttataactttcacacgcacttggtttcccttgatctcgtcaccatctttcagctttccaatactacggatatccaaacggacagaagcatagaatttcaatgcgttaccacctgtcgtcgtttcagggtttccgaacattacaccgatcttatcacgcaattggttgatgaagatacaggtcgtattcgtcttattgatcgcggccgtcaacttacgaagggcttgcgacattagacgagcttgcagacccatcttgctgtctcccatatcgccctcaatctcggctttaggagtcaatgcggctacggagtcgataacaatgatatctacggcggatgaacggatcaattgctcggctatttccaaggcctgctcaccgttatccggctgggagatccataggttctctacatcaacgcctaacttttcagcatagaaacggtcaaaagcatgctccgcatcgataaatgcggcgatacctccttttttctgagcctcggcgatcgcatggatcgctatcgttgtcttaccggaagattccggaccatagatctcgacgatacgtcctttcggatatccacctacgcccagcgctgcgtttaaagcgatagagcctgtcggtatcacctcgatatcctcgatgctttcatcgcccagtttcatgatcgaaccttttccgtagttcttctcgattttatccattgccgcacgtaaagcttttagcttatccgtgttagcggctggtttaccaccttcttctttcgctttttcttcgaacaaattttcttcttttgccatatgtgtcccttataaattaaggatttgatttgcatggtcttttgtcttcacctctttcggtccgatgatatttgtaacaataccttcctcgttgatgataaaggtggtccggagagtccccatgtatgaacgtccgtacatttttttctcagcccacacaccaaacagttcttgtaaggccgtgtctgtgtccgctattaaacggaaaggtaagttttgcttttgtataaagccttgatgcgatttggcgctatctttgcttactccgatgatttcgaagcctttcgcttgtaaggcttgatagccgtcacgtaagctgcatgcttccgccgtgcaaccgcttgtgttatctttcgggtagaaatatagagctactttctttccttgatagtcactcatctttacctctttaccgtcttgatcggttcccaaaaactcgggaaccttatcgcctatttgtattgccatattacaattctaagtcaatgttaaacaattcatgccaaggcaaaccttgctcatttagctctttcatgaatgggtccggattgaattcctccacattccatacacccggtttcttccaaatgccttgcataaataatttggcgccgatcatggcgggaacaccggtggtataactaacaccctgcgctcctgtctctagataagcggcatggtggctacagttgttgtatacgtaataagttaattccttaccgtccttgataccacggatgcggcaaccgatggaagtctcgccagtataattctctcccagatcacccgggttcggcagtacggcttttaagaattggatcggaacgatttcctgcccgttgtaaaggatcgggtcgatacgagccataccgatattttggatgacacgtagatgagtcaagtattcctgtccgaaagtcatccagaaacgagcccgtttgagggtcgggaagtttttggtcaaactttccaattcctcgtgatacatcaaatacgattctttcggtcctacattcggataattcaaggctttatgtacgcttaacggatcggtctccttccattccccatcctcgaaatatttgccacgttgagtaatctcacggatattgatttccggattgaaattggtagcgaatgccttatggtgatctcctgcgttgcagtctacgatatccagatagtgtatctcgtcgaaatgatgctttgccgcataggctgtatatacgccggtaacccccggatcgaaaccacatcccaagatagcggtaagaccggctttctcgaaacgatctttataggcccattgccagctgtattgatatttggcttcatcaagcggttcgtagttggccgtatctaaatagctaacaccgtattccagacaagcatccatgatatgcaaatcttgataaggtaaggccagatttaccaccaaatccggtttgaaggcgttaaacaaggcaacaagctcttgcacgttgtctgcgtctacctgtgcggtttgcactttcacgttcttgatatcggcggcgatcttgtcgcatttacttttcgtacggctagctaccatgatatccgtgaagacatccgcattcatcgctattttcttaacagcaacggtacttacgccccctgcaccaataactaatactcttcccatttactaatagaattaatcttgttaatatacagtttacaaggttttcaaccaatggacaaatatacggcttttccttgacaatccctatatatttattcattttagaacggaagagggaaaagaaagatacagctaatgaatgtgaataatgaaaatagtcgtacttttgtcacatttactgtttaaagtttggacatgagattcttaaataatgtcgggggtgtttttattctgcttttattagcgttggggtgtaaacctgaggcgaagcggagccgtgtgcttgtgatccaatcttttcggtgggatgataagaactatctggaattaaactcagatatccggaaagagctgggaaaaaatcgggtgaatgcggacatccgtacgttttatctcgactgcgagtgttatatggctgaggaggaagaggaacggatgtataactttatcgatacgatccgtctttggaagcccgacatcatattggtgaatgatgatcaggctacctatacgttgatgaaatgcggccatccttttgtaaagaaagttccggttgttttctctggcgtcaatttccctaattgggatttgctggaagaatatccgaatgtaacaggtagctgggataagattgattatgaggagaaccttcgtttgatcgatcggcaaatgggaaagtctcgcatttatatcaattatgataagacctccttagggcagttggctttccgggagttgataaaagcggtcgatacgagccggtatgtgttggattataatcaattggctttccaattaaatgatccggactttaaggtggattccatgatgtttagaaccgagatgagaatgaaggcgatacgtccttcgaaaaatataatccatttcatgccttttcgtaaagccaatggggagtttttattgagtaatattaatggtacctatccttattgcgtatttttcaatatccgttatgactatacatccgcaggcttgtctaagatgttcgtgactccttcatttacggcagtgcgggaaatctttaatataaacgtggaagttctgggaggctatttttgctcgaaccgcatacaagcggcggaacaggctaggttggcggctaaaattctttccggtacgcctgtctcttccgttccgatcgtagagagtcccaaagagtatctgtatgattgggtagagatgcaacgtttaggtatttcaaaggaagaggtccctactaatgttcatgtcataaatatgcctatttccgaacggtataagatagaggtttttatcgcctcttccttgggtgtgatcttattgttggcattgatcggttatttgttttatctctattggcgggaagcaagacgaaggaaagaggtgctcgctaatttaaagcaggagaaagagcatctttctttagcgttggaagggggtaatatattcgcttggaaattacagtctggaactttccggtttgacaacgagttctttagctatgtgaatacttctcctcgggaaattcctttggatgagctgtacgagatggtccatccggacgacaggcagagtttgcgatccttaattgatttcatttgtacgggtacgatctctcatcatatccttcaatatcgttgcgattttaacgggaaaggttaccaatggtgggaatttcgttacggaagcttagaggatgcgaatgatgggtatgtaatcaatggcttatgtttgaatatccaaaatatcaaggatacggaggaggtattgatctctgcgagggaaaaagccgaggagtcggatcggatgaagtcggctttcttggcgaatatgagccatgagatccgtacgccgctgaacgcgattgtcggtttctcgaatttaatgaactcggaagaggtcttggagccggaagagcgtgagcagttcgtgaagttgattaatacgaactccgacttactattgaaactgatcaatgatattttagatctttcccgtatggaatctggaaagatgagttttgttttcgatcgccatgatttgaatgtcttgatcaatgaaatctattgtactttccaattgatgatgcccgagggggtagagctacgcatgcgtgtccccgagatcccggtggttgtggcggtagatccttatcggctgaaacaagtattgtctaattttatcaataatgccatcaagttcacgacttcgggctatatagaagttggatactatttctgtacgaaaggcgactgccttcatatctatgtagaagacactggtatcggcatccctgaggagaaacagaagcaagtctttgatcgtttttgcaaattggatgagtttgcgcaaggcaccggactcggactggcgatttgccaagtgatagcgcagcgtttcggcggtgagatacaattgaagtcagaatatggtaaaggtagccgttttacgctaactttgcctaaagaacgtataggttgacaaagcatggaacaaatagaggaactttcacgatttatcaaggaacatgcgtcggatgatttgaatcgtctgttgctttccgcctctcgttatccggggatcgatatccctttcgtggtggatcaattaaaatctcggcggcagatcaaggataaactaccttcatggtatcaaaacgatcgactggtttttccggtgaagatagcggcggagcaatgttcctcggaacagactgccttgtacaaacagaggttggtagatccacaggcacatgtatgtgatttgactggtggattggggatcgatagctatttcttctcccggaaagtacggcaggttacctatatcgaacgcttttccgcttattgcgaggcggctatccataatttcaaggtgctagacgttggtaacgtaacggtattgaatggtgattctacggagttgatagataagatcgatggaatagatgtgttttatatcgatccggctcgtaggggagaggggaataagcgggtttttgcgctgcaagattgcgagccggatttgacaaagttggttcctgtcttgtttggtcatgcctctaaggtgatcgctaaattatctccgatggcggatattcatatgacgttggatttgcttccggatgtgacagccatacaggtgctttcggtgaaaaatgaatgtaaggagcttttgtttgtgttggagcgaggctcgaaaggcgggagtcctcaaatctgttgcgtgaatttcacttcggaggaagagccggaattgtttgtgttctcattggtggaagaacgggaagctgtcgcttccatccgtggagaagtcaagcgttatttatatgaaccgaacgcttccatcttgaaggcgggtgcgtttaaagcggtcgccactcgttttggattgaataaattgcatgtcagcagtcatttatatacgtcggatgaggttgtccctagttttccgggacgttcttttgtggtagacgaagtgatcccctttacgaataaacaatgtaagaccttgtcgaggcagattccccaagcgaatatcacagtccgtaatttccccctctcggtggatgagttacgtaagcgaactaaaattgtggatggaggaactatctatcttttcgctactactctggaaaatggggataaggtacttatcaaaactcataagatataggatactgcatgggcgttgcagtgttactgcataggtgctgcagcattactgcataagggttgcagtactattgcaaggcctgttgcagtgatatccgaagggatataaaaaaagtgtatgatgttatcaccatacactttttatgatatgaggtttatattacttcaatagattcgcacgcatttcctcaatcttagcttttgactcacgagccgtatttatggttgctaccattccgcttaacggagcgattgtagttcctaattgctccaagtcaggataatatttagctaagtcggctgtgatctgctggatgataccgatacgtttttccatattctcgctcaaaccggcggaaatagcgtcgcctttaacaaccaagcccgggtttgcgtatacaatggcatattctacagccatgccccctaacaactcaagctcaacgtcagccttatcattttccatcatagcgtcgatcaatttgttttcttggtctttcatgaatttgcttaactcctctttgctggcgttagcgggagcggactctttcatgatgtcgatagcgaatggaatgtccagatccgtagtcaatttaaccaatacgttctcgatatctgtagtcggctttttcatagccttcaatacgttcaagtctgcgaagtagataccgcaagcacgtgctttctgggcttgtgtgttcaattcggaaaccttgctgaccggcaacataaaatcagtattagcgacagagatcgtaacctcgccggtagatactttgtaaggcaactccgaatccggcatatctttcaagaaacgagtaacctcgtctttcaactcggcagtaagcagacctttagatacttctcctgcgatagctgcttcttcctctactttttgctcagcggcgtcttgttttttactgctgttgcaagataccattccaaatgtaatcgctgctatggttagcaggctaacaaaactctttttcatgttattctttatttttagattatatattttgtcattaatcgctccctttgtttaaatacttgccgggaaactctgcgaagatagatataattaccaataaagcaaagattcctaacattaataaattaaatgtaaaagtagaaaatgtataaccggcgaattttttctcatgactatagaaaggcgcacgtccccaattattgtccggttccagataaatctgcccgattttaggatagatccggttgtgagcctccttatagaattgggtactggttgagttaagtaccagttcctcaatggccgagttatggtgctcttttttcaaggtgttcaaccattcggagccatgttcttgaatgacctctttccgttttttctctaataacgccgtgaaattatcgctacgggtatgcagggctttttccactttatccatatagctctcgtaactctctttggacgtatagggggcgatacgggcggcacgggatagtacggccagttcgttgtggatcgtccgggtgttttcttcccgtttattcgggatcaggttgaggctgtttatgaggctgcgcacctcgtcggcatggacattccggtaatattgcgctaggaacttttctttttcgaccgtgaaaaataggcggttgtagctgttgttccggaattgttccgtaaccaacgcctcgaatgcccaacgtgaggggataacctcaccgataaggggcactatgttccggctggatgcgctcctgctcaaatcgtcgaacttgacaactaagccgcaaagtaaaatctgcgggattaaaagcagcggtatcgttatatagatcgctacgatcgagtttaaagattgcgatagtatcaaacctgtcaggttggcgaggaatgaggttgcccatagcgtgatccaccaagtaaggaacatctcgcttccgatgcctatcaataaatttcctaccactatgaatagcaaactttggatcgctgagatacaaagcaggtagaacatctttgacgagagataactgcctcggctcaatcgcaagaatcgttctcgctttaggagcgtccggtccttgatgatctcttcggcgctgatgcttaatcccgtgaaagtagcgacaatcaccgccatgaaaatgtaggataccagatttttgttcgccagcaaagaatacccgtcatcgggtacgaagcgggtgagcagggccacgatcaccgccaataaaggagtctccagtaaggcgatgcacaaatactgcttattggtcagcttggtttttatgtttctttccaagaagatacagaattgcttccagatcgagggcttctgctgatgattcgggggcaggggggtaggcttaacctcttggaacttcgggcgggaagctacatataactcatgccattcttttgaagttatcttccggatgtttgtctggtttccgctatcgtctatcttttttgcgtcgataatagttaggattaattctggattgatatttccacaagtgccgcacacgctgatatcctgatcggtgtaattggcgatccgtttgaaataagtgatcgcctcgatcgggttaccgtcgtaaatcgggtaaccgccggtatctaataaccacaggcgatcgaacaacttatagatctcggacgaaggttgatggatattgacaaccacgagccgtccccggtgcgtttgttcctttaacagcatgatgaccttctcggagtcggtggacgagaggccggaggttggctcgtccaaataaaggatcgccggctcacggataagttccagtgctatatttaaacgtttacgctgccctccgctgatcgttttccggattggagacccgacggccaaatcccggatcttgctcagatccaaatcctccagtatcgtattgacacgatcctcgatctccttttcggtcaggttcgcgaaacaaaggcgggcggtataccatagattttggaatacggtcagctcctcgatcagcaagtcatcctgaggcacgaaaccgatcaattgcttgcattccggatcactcagcggatgtccgttcaagcatacacttccctcaccggggataatattcccatttaagatgcttaacaaggtagacttaccaacgccgcttcctcccatgatggctaccaactggccggattcaaggttgaaagagaaattgtgcataccgttctcgctatttttgaagctgaactcgatatccctcccggttaataaaatacgttccttatgctcattctgattgaatacatcgaggacatcactataataaaccggcaagaatagcgggcttttgattacgctgctacgttgccagccatagaagataccggaagtaagcgggatatcgttcatgaatacccgtccgctgccttggtagataaagaccattcggtcgaaccgggtcagtctcaacacccgtatctcgccctccaacccccttctgtagatatggttgacgtctttatcgctatcatcagcgttgatcgtaagtatggagggggattttttaccgacaacaaaggcgtatagattgtcgaaggtatccgtgtcgatattaaatatcgtagcgatcttatggaaaatggctaagttctcgttcaatccttcattgttgccatgggcgaactccatgaaacggagaagaagcaatagctggtcttccgcaatcaatttgggcttgagctggttgcatacgttgataataacactctctctatcgatatcgaagtccggatcatcgtaaacactttgtatctcatcaaatagctccatatattctttatgggagcggataccaaagtgactggttaagtaagaattgacggcctgacgcgcttggtcactttctatttttgccaacgaagcaaatatagcgaacaagttcagtagcccattgagtatagtttcattcattcatcaaagtattgtttcaaatgtcttgcaaagataaggtaagtgaaacaaaaaacaggtcgaatgttagactttttaagcagtcaagtgaataacatgatcaataattgggcagaaatcacccggatgaacatggataacgggtaaaccgtagcgtaagatacggaaggctcgtcaccctcgacggtcgtattggcataactcaaggccatcggattggccatgcttccgcatagcatacctatgttgtgggcgtaatctagcttgaagaattgcgaggcgatgaacccgacgatcaagaccggtacgatcgtcaataggaaaccgaggccgatccataacaatccttcggcacggaagacggtctcgaaaaaatgagctccggagtcgattcccagtcccgccagatagatcactataccaaactgccgcatcatcaggttcgcgctctgggtggtataagtcgttaggtggaaacgggggccgaacgcacccatcaagattccaacgatgatcggtcctccggcgatacccagcttgatgggggtactcattcccggtatggcaattgggatcgccccgattaatacgcccagcgtaagtcctacgaatatggcaagcaggttggggttatccagccgtttcagctcgtctcccaagatcttacccacgttattcacggaattggcctcgcctacgatcgttagtttatccccgatctgtagacggaggtcacgggaggccaccagatcgatacccgcacggttcactcgggtgatgttgatcccgtataggttgcggagccggagcgaacctagctttaccccgtttatccggttgcgggttacgacgatacggcgggagatcaattggcagtcgatagcgttccagtcaatatcttccttattccagtccgtagtctcttgttctccgaaaagtaccttgatggattcgacatccgcctttacggatatgataagcaaatggtctttttcctttaagatggtttcagaggtagggatcgtcacctttccgttcctccagaggcgggagatcacgaaatgtttctctgtcaatttcatgacttgctggatgctcttattgtaaatagaggggtttaatacctgaaattccgctacgtttgttgtcgtgtcttgctccttatgcgtgttctgtgtctttttagcgaataaggacctcaagatgataatagcgagaattacgcctacgacacctaatggataagctacggcacaggccagagccatatccgttacgttcctcgtattttccggatccatctgtaagagcgcttgctgggcggcacctagggccggggtattcgttacggcaccggatagcaaccctaccataacggggacggagattcctgttatccaatgaaacaccaacgtcaaaatcagtcctaaagcgatcacccctaatcccatcgtattcatttccaccccgcctttttttagggaagagaagaagccgggacctacttgcaatcccaaggtatatacgaaaacgataagcccgaagttctgggcgaagttcagcatgtccttatttacggtaatgcccagatgccctgccataataccggcgaagaatacaaaagtaatgcctaatgaaatgccgaatatctttagccgccctaaatacacaccaaccgccgccacgatagaaatgacagccacggcctgtatcatcgagggttctgcaagcgtctcaagtaaccaattcataagagtttcttttttgctttagaagcgcgaaaatacataaaacaaagcaattaaaaaaattgtagtatctttgcccacgaaataacgatgatacagggtgagagaaacgatggttaaatatataaagtggttgctgccggtactttttatcgcatattatagcagcgtctcgctttttacgcacgtccatgtggagcatggtacgaccatcgtgcatgcgcaccctttcaagaagacggcggacggtacttgccatcatcatgcctctctggcggagatacagttgtttcatatgctctcgtctattcatgcgatggacggggcgatccatccgtttcgtttgcatttctattcatcacagatatcccatctttccgagtctccggtctatccggattatgtcgcttccgttgagggagtgcgatacctgcgggctcccccggttgtttgattacatatccagaaatcaatatccgtttgtagaggtggggcaggccctatctctatatcgggcattgggcgtgcggtaatttatgccgttgattcaaatattgtatttatctaaatattcaaacaactattaatcaagcaatgaataagtttattacacttatactatgcctgtgctgtatctttacgtcagcgtgggcagagggagacgatcatgtttccttgaatccttccgacgctaatatcgtaggtcatatcctcgataagaaaacaggagagcatctctcttttatcaatgtctatctccacggtacgacaatcggtacgactaccgacgctaccggtcattattatatgaaaaatcttcccgaggggaaatacaccttggtcatgaagtctatcggttataagaccgaggagaagacggtgactcttaagaaagggaaaaccttggagattaatttcaatgccgaggaagacgctgtctccttggacggagttgtcgtatcggcaaaccgtaacgagacgacccgccgtctggctccttccttggtaaacgtgctcgactctaaggtgttcgagaccacacacgccacttccttggccgacggcttgaatttccagcccggcgtgcgtgtggagaataactgccagaattgcggtttccaacaagtgcgtatcaatggtctggaaggcccttatacccagatcttggtggatagccggccgatcttcagcgccctgaccggcgtatatggcttggagcagatcccggcgaatatgatcgagcgggtggaggtgatgcgcggaggaggctcggccttgttcggctcgtccgctatcgccggtacgatcaatatcatcacgaaggagccgatgcgcaactctgcccagatcgcccattcgttgacgatgatcgggggaagccgcccagataacaataccaccgtgaacgcctcgttggtgacggacgatcataaggcgggtatctacctcttcgggcagggccgtcaccgcgcctcttacgaccatgatggcgacggctactcagagcttggtaagttggaggcgaagaccctcggattccgttcctacctaaagaccagcaattactccaagctcactttcgagtaccataacatcagcgagttccgccggggcggtaatttattgggtcttccgcctcacgagacggatatcaccgagcagaccgaccatcagatcaacgggggaggcctgaaattcgatcttttctctcgtgactatcatcatcggctgaatgtgtacacctccgcccagcatacgaaacgccagagttattacggcgccggaaaagacccgaacgcctatggtaacacgacggacatgacctttatcggtggcgcccaatactcctacgaatgggacaaatgcctttttatgcccgctacctttacgggaggtgccgagtatagctacgatgatttgcaggacgagatgcttggttataaccgtacgatcgcccagaccgtgcatatcggtagtgcttttgcccagaacgagtggaagaatgatcgttggagtttcttgatcggtggccgtttggataagcataatatgatggatcacgtgatctttagccctcgtgcgaacgtgcgtttcaatccgacgaaggatatcaacctgcgtatgtcgtactccagcggtttccgggctcctcaagcgttcgacgaggatttgcatatcaccgccgtgggtggcgacgtggcgatcatccagatctccccggacttgaaggaggagaattcgcagagcgtgagtgcttccgtagatttctatcatcgcttcggcccggttcaggtgaatttcttggtggaaggtttctatacggatttgcggaacgtgtttatcttggaggagatcggccgtgacgaggataataacctgctgatggaacgccgtaacggaaagggtgcccgtgtgatgggtatcaatctggagggtaagatggcctattcttggatgcagatacaggcgggcgctaccttgcaacggagccgttacaaggaggcggagcaatggagcgagaatccgaatatcaccccgcagaagaagatgttccgctctccggacgtatatggttatttcacttctaccttcacgccggtcaagcgtttctccgcttccttgacgggtacatatacgggaagtatgttggtgcagcacttggcgggttatatcccggaagatcgtgaggagaagactcgtgatttcttcgacttgaatctcaagctggcttatgacttcccgatcttcaagtccgtgactttacaggtaaatgctggagtccagaatatcttcgactcctatcaagatgatttcgacaagggagcgcaccgggatgccgggtatatctatggcccggggattcccagaagttatttcgtggggtgtaagatcagttattaaatactcggcgagcctccgcggggctattcctccactattctctctatataatttggtggcagggtggtgcgtggcactttcatgccgccaaaccatttatgcaaaggcaaatcgaaaccagttccattcatgtaattatagagagaaacgcgaagcccctcgctgaaaagctccggatcgcagccggaaagcgcctcgaactgtacgtcattacgggcgaatcccccaaagggagactccgtgacacggcaactgtactcggcggggtgcaaccccacaggactatgtgctgtcatggcgaaacgatgccaaaatccggattggatcagccctagctcaaacatttgccggactgtttccaaggaatctatggtttcttgagcggtttgggtcgggaaaccatacatcaaataggcatggaccatgataccagccccggtaaagttgttggcgacccgtgccacctgagccactgtcacccctttatttatcagtttgaggagtcggggagaggctacttccaggcctcccgatacggcgatgcagccacttcgttgaagaaggtcgcatagttcctcagtatagcttttctcaaaacgaatatttccccaccacacgacggttatcccacggcggatgatctcctgcgccatttcccgtagcaaggcgggtggagcggcctcgtccacgaaatggaagccgatctcaccggtttgctcgatcaagcgctccatacggtctaccaaagtcttggctgtattcggctcatatcgtttgatgtaatccaatgagccgtcgcagaaggcgcatttcccccagtagcaaccgtgcgccaaggtcagtttattccagcggccatcgctccaaagcttgtgcatcgggttggccatttccatgacagagatgtatttgtccagcggcaagccctcgtaatccgggaatccggtctcgctttgccggcaagcggggtaagcgggattatcttgataaacgacccggctaccgttctcgtccaaggagaaggtgcgtaccagttcctcttttgggatcgccccgtttagatagcgtaacacttggaaaagtgggtcctctccatcatctagcaagaggtaatcgatgtatttgaagaagcgtgtatccgtgatggagcgaagttccgtattcacgaaaccacctcccataaggatcgggatatcgggatgtgcctgccgcagccactgggcgagcctaagggtactgaataaattccccgggaaaggtacgctgaatgcgatcaccttggacttgctctcggctatgtgcttttctaatagcggctgcgtcatgcgatcgataaagctgaaaggcttttggagggcttcctcgatctcgtcgaaggaggaggcgcagcggcctagatgctcggcatatcggctgaaaccgaaatccgggtcgatcgtttcccggatcaagtcgcagagatcctccagatacaaggttgccagataacgggctttatcccgtaatcccgaagtaccgaatgcccattccagctcctcctcgttttggctcccgcgatcgctttctggaaggtaatcttgattacagatgcgataagcgagaggatcgttctttccttgaaggaaagcgacaacggcggttatcgtgtcgatataccgttgcttattagccagcatcccccggactttagccggatatttacctttccgtcgctcgatctcggcgaataactccccgagaccctgcgtggaaaacaaagtcaagattgtctcgatacccagatccgcctgcccggcacgtacaccctttgcctccaaataaccttttaggtaagccgtggaaggataaggcgtattgatctgcgtaaacggagataaaaccagaagaaccgaagctaatcccatatcaactcaactaattttcaattattcaagctattgttgatagactcgatatagtccagaatctcatcccgtccctctttcttctccgaggaagagaggaagatcggaggaagctcttcccaagtctccagtaatttatccgtatagacttttaggttctctttcaagcgtcccttgctgatcttgtcgatcttcgtgaagatgatagagaaaggaaccccgctctcacccagccattccataaactccagatcgatcttttgcgcctcgtgacggcagtccaaaaggacaaataggttggtcagttgctcgcgatcgaggatatagttctcgatgatacgtttcaattgctcccggttctccttgcctcgttgggcgaagccataccccggaagatctaccagataccactcgttattgataagaaaatgattgataagtaaagtcttacccggtgtttgcgaagtcatcgccaagcccttcttgttggtaagcatattgatcaaggaggatttgcctacattacttcgtccgatgaaggcatactccggcttattaccctcggggcatttccttacgtctgtgttgctgataacaaattctgcgcttttaatttccataaaatataaattaatgaataatgagtaaatgaataatggcgagacctaattctcaattttcaattttccattttcaattgccgaaagccacagcccgacgaacgtgatgcctccgtttaccataagcatctcgtagccgaacgtatagcctgcgtattgtttcaccaaaaaatccgtggcgaggcaaatcaacggggaggctatacagatatagggcacgtatttgtcacggggtttccgcttcgtgaaaagcccgaaaacaaacagccccaatagaggaccatacgtgtacgacgctatcatgtagatcgcgtcgataacgctccggttatttacggccttgaacgccaagatgatcaagacgaacaagacggatatcatcacgtgtacctttaggcgggtacgtttcgcccttttcgcttcctctctctgcacgccgaggatatccacgcaaaaagaggtggtgagcgctgtcaacgccgagtcggcgctactgaaagccgccgctatgataccgatcgtaaagaagatcaagatactcccgcccaagatccccgaggtacaaaacatcgggaggatatcgtcgttgagggttggcaactggatgttccgctgtgccgccaatgtcagtagcagtacccctagcgcgagaaacaaaaagttgaccggcgtgaaggcgaatccataagtgtacatattcttctgggcatccttcaagctcttgcaggagaggttcttttgcatcatgtcctgatccagcccggtcatgacgatcgtgataaagataccgctgaagaactgcttgaagaagttctgcgtactatgccaatcgccgaactcgaagatccggaaatgaggactttccaccaaggtctgcgccatacccccgaaatccagtcccatcttatctttcacctgccagatgatcacgatcaacattgccacgagacaaagggcctgcaacgtatctgtccagatgatcgtcttgataccgctccggaacgtatatagccataccagcaggatactgaggatagcggtcacggcgaatgggatgttccaagcgttgaacacgtaggtttgcaagatcaagaccaccagatataagcgtgcggccgcccctacgatcttcgagagcaggaagaatgaggcccctgtcttgtacccccttctcccgatccggtcatccagatacgagtagatggaggtaagttgcaacttatagtatagcggtagcaataccttggctataatgatatatcccacgaagaagcctaatacagtctgcatatacgtcatatcgatcgcccgcaccatgccgggtaccgatacgaacgtcacccccgataaggatgtccctaccataccgatagaaacaatataccaaggtgatttcctgttcccgaggaagaatgcctcgttgctgttattacgtcccgtgatccatgctatcagcagcaagacggcgaaataggcagcgataataaaaaggatcatatagctgttcatgtattgctaacttctgtcttcttctgcgcaaagatacggctttactttgaaataaccggcatatgcgtggattctaccgtgatgggtttcttgaagccctttaggtagtccatgaaagcgtcagtcgatatgatacctaaattgtcgaattccgggatctcgtagcccttgaataaagaggcgtcgtacccgtctccgccatcggtgatgaaagcgtctagggtcaccacgcaagaggtattgtcctcgatctcggtcttttgcccgtctctcgtatagactattttctcgatcttatttccgcttagggtaagcgtgaggtcggaggattgaaggaaaccgttcggattcttccgtccatcctccaatagcttcttcaaccgcttgccgtcgaaacgataggcaacgatagcggagccgaaaggcaggatgttgccggcacgcagtcgggtgatatcccctttcgggagggccgcacggatacctccgtaatggtttacgccgatcaccggctgatccttgtaagcgggcatctctttttggaaacgcttggcgtaagcggccgtgaccaacgccccgataggcgtatagtcgaacttattgatggtacggtcgtggatcaaggcctcttttgccgtggcaagtttctcgttcagccgatatttatccatgatcttctccacggcctctcgcatctccgggttctcctcgcaggctacacgcacggtatccccttggatgaaagagatatcccggtgtccgttgaaatcctgtatctggaacagcagtttcccgatatgggtaccgtttacgccggcttggatgatggggatgttattgattttatcgagcaccagctcatgcgagtgggcggatatgatggcgtctaccttatcgatgaacggcagtccttgggcgttctcctcggtgatgcggtaaggcattttcatatccgtgccgatgtgcatcaagaggataatcatatcgatccggccctctttctttaattggtagacggtttgtatgcacgccgctcccagcggatgcgtgaactgaagccctttcaggttctccggcttggtcttgacgtaggtgtccgtcgtggtcagtccgatgaaggctatgcgcagggaggagccatctttcaacttacgctctacgatacggtagggactcaaccagccggggtgagtatatcttttctcctcggtgatattggcggccacatgggggatatttagggtggcggtgtccactaggtaaggaagcccccagtcgaactcgtggttaccgatggcggacatctccacgtccatcgcctcgtacatctctttgataggctcgcctttcgtgatcttggagaaatagcttccgctgaaattatctccgcctgagacaacgatggaatgcggatagcgttgcttctcgttttgtgtcatttgtaccaaccgggcggctcccggcgtgatcccgtcggaggcgaaagccccatggaaatcgttgaatgagaaaatggctaaagtgtctatcgagctagacggggtggcgatatcttgagcgaataggggagcggttagcgcactgcctagcaaaatcgccgatacgaattgttttttcagtcccatggttgtatgtattaatagggacaaaagtaggaaaaataatgggattcaccgaggaaaacgcccgattcgtcgaattctttttgatcgttttaaaccttcggcctacctttgcgtcatagtaatagctcgtgagagtgaaagcgaaccggttgttcatcataaccgggaaataggtaaacattaagtcaaagggccgtcatccggataagatgcggcccttttgatttattcggacttgaggttgtttacgggattgtcgtgggtggtacggaatacgttatatccggaaaccgccagtatgacggtgagtaccaatacgcctcctcccacgaatagataccaggatagctggatcttttccgagaattgctcttgccatttctgggagatatagaaagcgataccgcaaccaagtaagatggctggcaatgccatggtgatgatatctttcaagaaaatatggagtatgtcttttaccgtggctccgttaatcttgcggatcgccatttctttccggcgacggttcacctcgtcgttcgtgtatccgatcaatccgatgaagacgatcagcaaggtgacgataccaccgatcatgacggagtcacggaatttccgggaggaggtgtatccttccagcatctcgctcttgaaggagatcacgttgagttctttatccgggatgagttgccccattagatcctgcgtcttgcgtagggcctcggaagaaaggctatggtatcgaatgaccatatgttgggccgcccctttcgtatagaacatgatcttggctcgcggatcttctcccgctatggaacctaggcggaaatcctcgaacacgccccggatcgtgaagagaggcatcgactcggacttggtatcgtgtccggttatttgtaccgtcttgcccacggctccatccttccagtcggcgaaaggtttcatgtattcaatgaaattgcggctcaccagtatctcttgcgaggaggtggtattctctgtgaagtattgtccttctacgatcgggatttccaatacgttcaggtaatcgtttcctacgtcgtagaggtcggcgatgttgaatagttcccggtcgtctcccggaagatagacgttattgcccgaggctccccagaaaggaaggttatagcaagtcgtgatggcgtctacctcgggcaatctctgggtttcctcgatcagtttggcacgccccgtggagtctacggcgccgatatacacataggcgaggttctcgggattgtatcccggatgatcattcaccatatggtcgtattgcttgcctaccactagcaataaggaggcgaggaagctgattgccgtgaactggaagaacaagagtcccagtttccaaaggcggcgtgcttcacgaatactccggaaaacagccgctacaggaatgcgtcctaagaaccagccggtagctatgcccgtagagataagtacgactatgaccgtgaggcatatcgcccacatacccgtggataggaataacgatcggactcccgtgccgatcagctcctttataattccttgaaatcctaggatcaaaagtacgaccagcgctagcgcgatggtgacgtgggtccctacctcggacaacgccataccttggatatccttaccgctcgccccgtaacatttgcgtacggccatctctttcgtgcggttcacgatggaggagatcacgatcaatatatagttcattacggcggtgaagatcaatacgaaggcgatgaacgagaggatcaaggccatacgtttggccatatcgtcctccatatgtacgttgagtagtttgtggaaggtgaaggtcagttccacgccggctttcttaaggtcgtttacggggaaatgcttgtcgatcatctgtctcattcccgcttccaactgggcctctgtcgtacccggtgataccttgacataactttggtagcggtcgtttccggttaacatatgggttccgtcccacatgaacttgctgatggaagaaagggatacgataatgtcataactctgttcggtgttgtccggtagtttcttgaatacgccgcctatcgtgagggcttgtcccggcgcgtcgtcaatctcgaaacgttttcccatcacgttaccgccgatacgttcggcgatctcgtcggatacgagcacgtacatgggttgggagagaacttgcttagggtctccgatgagcatggggcggggcaatacgtcgaaaagacaactgtccgctaggatgaaggtcgctttgagccgatgcttgttgtcggacatcgtaaaaggggagtttccccggaagtacgtatagcgtgtggcggcctcgatctccggtgtctcttgtttcaagagggggattactccggcgggcgtttgcccgtggtcgcccacttccccgttcatgaaaaatttctcatatactcgatagatccggtctccgtccggatagaagttatcgtaggtgttctcgaagtggactttagcgatcagcaccaagccgatggtcagtcctatacccaaggagataatcttcattacattgtgttgccctctcttaaaaagggagcgaattgcgatcccgatgtttttcatattgttattgtattattttccggtaagataaaatcaaataccgtgccattgtgtttatgtggttgaaaaacagaggggtgagtagcgtatgattatttatgagtgtccaataattggacaagggtgtccagattttggacacctttgtttaataccttttctcaatagaggctccggggaaataatgcgtgaggattttccggtacgaataccctttggctcccatcacggcggctccgatctggcaaagccctacgccatgtccccatccggctcctgtcaagatgaagcgggaggggatatcgaggcggatatcctttttgtcgacaacaaaggccgagctgtatagatgcgtctcggataatgtccggcgtatctcaagctctttgccgatggtgaacgaacggcgtacccctacgatcttgagtttcgtgatacgtccggacgaacctctttccaacggtacaagatcgatgatcggcccgaaatccatacccgttttccggtggatcaaccccgatagttcctcttgcgtgtattctactttccaacggtagaaatccgtggtctcttgatcgtagttgtttagcacttggctaaggatctccttgtccgttgtattacagaaggcttcgggtgaggtacgtatccattgttccgcttcccgctcgtccgtcaagtcgggataggcgggagtctcgccgtccctcaatgcggtaagataggagtggggaaccggttcccagcaattctcgaatttctcggtcacgcctccgcagcatttcgagaaccgggcgtcgcagatcgtatcgttatccatcaatacctctccacgggtctctttgatcacctccctgactatcgggttcgatgcccgggtaataccttggtaacgctggcaatggtcgtcggcacagacatcgaacaactcatggtcctcccggtcgtaccagcggatcaaggtctcgttgtcgcggtaacaacttttatagggcgtaaccgatccgttcaagttgaaattcttctcgacctgcgccaagagccagcttcgcgagatcacggcatgggctttcagcaactctttggaggcgttggcgctcatctccgaggagattacgctggtaaggtattcctccacgtccacttggttgatcgtgacgattcctttatcggtcgccacgaggttcaacgctcccttgaagcgttgatcctcctgtcgttgccagtgaaaatccacgccgatcgtgaccgccttcaagtcgaaagaggattgcgggctggtcggctcgaagaatagctcctgataaagcttcccattgtacacgatcttgccgtttacccagagggcacgttgctcgcctatggtgaacgtgccggtttccgtatgtacatactcttcgttaaaaacaaatgagaccgctttgtgggtcatgattcccacattgattacaggtgcttccatatccttattcctttattctattcttttttcgcgttcagggaattaaatgtgaggtaagcgatcatgacaaggtacatgacaaccgccagtatctcggcggcattgctagatgcccattcctcgttcatcaagttgattccgccgaagcgtaaggccgcactgaccacccccatcaaggcaccgccggcgataaagccggaagccagtaacgtacctttctccaagcgggccgagttcaagctttggtctttgctacggcttcctacgtaccaactgatcgctccaccgatcaaaagcggcgtattcaggtccaaaggaataaacatacccaaagcgaatgccaacgccggtatcttgcagaagttcaatacgacggcgaggacggctccaatcgcatataaagcccaaggtgctccggaaccactcatcaacggctcgataacggcggccatagcgttcgcttgcggagcggccaattgtccggtcgtgaaaccgtacgtctggttcaatatcaagatcacgcctcctaccgtagcggcggaaactaatgtgcctaagaatttccaagtctcttgcttggcgggtgtgctccccagccaatagccgatctttaagtcggtaatgaaacctcccgccatggaaagcgccgtacaaaccacgcctccgataatcagggcggataccatgccggccggccctttcaaccctacggcgaccaagatgatggaggcgaggatcaacgtcatgagcgtcatgcccgataccgggttcgtccctacgatagcgatagcgtttgccgctacggtcgtaaacaggaaagcgatcaccccgaccagcaataagccgatggcggcatggaaccaattatgaagtacgccgaactggaagaacaggaaggtgacgatcagcgatacgatgataccgatcgttatcactttcatcgacaaatccttttgcgtacgtatagtattactctccacagcgtctccttttcctttcaactcgttcgccgccaagcctacggctcccttgatgattccccaagagttgatgatgccgatcaccccggcggtagcgatacctccgataccgatgtggcgggcataggtggtgaagatttgctcggcgctcatgctcccgacggtcgccgtgatagcgtcattgccgaacgtaagtacgtcggcgctgaaaatggcggacatggcggggatgatcaccaaccataccaagaatgaaccggcgcagatgatcaaggagtattttaatccgatgatgtaacccaaacctagcacggctgcgcccgtattgactttcaacacgatcttggctttctccgccagcatctcgccggccccgacgatacgggtactgatcgtctcgccccaccaaccgaaggtggcgatgatgaagtcgtacaaaccaccgattaatccggcgaatatcaagggtttcgcttggcttccgcctttctcgccggagacgagtacttgcgtggttgccgtagcctccgggaagggatacttaccgtgcatatcggatacgaaatatttacggaacgggattaatagcaagatcccgatgatacctcctaacaaggaactcatgaaaacctcgaagaaattgaccgtgatctccggatatttgtcttgcaggatataaagggcgggcaaggtgaaaatggcccccgctacgatcacgccgctactggccccgatagactggatgatgacgttctctcccaaggcgttcttccgcttgaatccgctggacaaccctacggcgatgatagcgatcgggatggcggcctcgaatacttgaccgaccttcaggcccagataagcggccgccgcgctgaatatcaccgccatgaccaatccccaaaggacggaccaaggcgtaacctccggatagtgtttgttgggagacataagaggcttgtagctttccccttcttttaattctcggtaggcgttttctggcagcccggttaccttttcttcattttctggtttcacgatattaaaatgttagattataagttcgtaatagctccaccaaacgggtgttgggtgacaaatttatgttttctggctgagacatgcaaggattctttagaatagttagggcaaccgtacccaaattatctatatgaattcttgcccagtagcgtatgaattcttgttcgcatgctgtataattctacaaaccacggcgtgatctgtacagaccaagtcgtggaatatacaaatcacgtcgtggtctgtacatcccacggcgatcatttggaaatagatcaagtagtaagtatgttcgtatatggcaaaaagaatgtttattacttgaggacatgaacaattatacctagagcagttatagttgtacatatcaagcaagagatgtgcgacttgaatgggatgggggagaagccgagtaaataatttgaggtttatcgttaattcgtaaattctttctatttttgtagtcaaatacagaaagtagatgaatcaaagatatccttcagccttgttggaaaatgccgtgaatgaattggcttccttgccgggggtggggaggaagacagcgctccggctagcgctttatatgttgcgccgggacgtcggctatacggaaaacttcgccgcggccttggtcgccctccgtcgagacgtgaagtactgcaaggtctgccataatatatgtgatgatgaggtttgctctatttgcgccaaccccagccgtgaccattccttggtttgcgtggtagagaatatcaaggaggtgatggcgatagagaataccggacaattccgtggcgtataccatgtgttgggcgggatcatctcgccgatggatggtatcggaccgggcgacttgcgtatcgacagtctggtgcggcgtgtggccgaaggtgaggtgaaagagatcatcttggcgttgagcactaccatggaaggcgatacgactaacttttttatttaccggaagctatccggttacgatgtgaggatcagtgtcatcgcacgtggcgtatctatcggtgacgagatcgagtatgccgacgagatcaccttaggacgatccattatcaatcgtaccgagttcaatctcacctcttctaattcataaatcataactcataattaatatccggaatgacctacgaagaaaccaagttgtccgttatcatcgttaactataacgtgaagtattttctggagcaatgcctctattctgtccgtgccgccgtaacggggatggacgccgaggtgttcgtggtggataataactcgacggatggatctgtcgaatatctccggcctaaattcccggaggtggttttcattgagaataaagataatcccggtttcgccaaggctaataatcaggcgattcgccagtgcaccggggaatacgtgttattgctgaatcccgataccgtggtgggagaggagagcctccgcagcctgtgcttccagatggatgaggatctggagatcggagctatcggcgtgaagatgctgaatgggcacggggtattcttgccggagagcaaacgggctttcccttcgccttgggtgtcgttctgcaagatattcggtctttcaaagctgtttcctaactctcctgcattcgcacgttatagcctgccgtatctggataaagagcagacgcataaggtggaggtgctggcgggtgcgttcatgttgcttcgccatgaggcgttggataaggttggcttgttggatgagtcgttcttcatgtatggggaggatatcgatttgtcttatcggatcgtgttgggaggctataagaacttgtacgtgccggaacggatcctgcattataagggggagagtacgaagcatggtgacttgaggtacataagggctttttacggcgccatgttgattttctataagaaatattatccggggtccggttggttgatgcggatactgatccggttggctgtcctgctgaaagcttgctgggcgacgatttcagcccctctacgcaagaaggctaaagcggttaagcatcgccgccttttgatcttgtgtagggaggatcattttgaggaggtaaaggccgtttgcctgaaagctatgccggatctggaattcgtgaatctctgggatttggacgtggagcgtgtgatggatgctatctgtcgcaagaaccagatgaaaggctttacggactacgctttctgcttccccgatgcccgttacgagcagatgctcttgtttatggacaagctcgtgaacaagaaagcggtttaccatatatatacgaagaagagtggtcggcttgtttaagtaatccttgggtaaatatgttattgtcgaatgatagagtccgtttgagggcattggaaccagaggatctggagttgttgtatcgttgggagaatgatccggagttatgggaagtagggaataccttggctccctattcccgttatatattgaaggaatatatagcgggtagcgaccggagtatctatgagtctcgccaacttcgcttcatgatcgaggaatgcgatacggggacttccgtggggatcgtggacttattcgattttgagccgcatccgaaccgggcggcttgcggtattatgctggaccgtaggtatcaaggacgtggcttcgctacggaagcgttaagactattgatggaatacgcttatacgtttttgaagcttcatcaactttatgtgcatattcccgtggcgaacgagcctagcaagaaattatttacccgtctgggatttgtcgaggcggggacgcttaaggactggatcaggacaccggatggttattccgatgtctgcataatgcagttaatttaaatacgggtccttcggatattttgtccaagttttataatcattgcctaataattctacggaatctttccaatagccctccccatcggcagacaggatattatcggtggtgatatggcttacggcccacgagttccgtttgatttcatggtttaattgcccttcggtccatccggagtatcccaagaaaaacttcactttcccatcgattgggtgcccgttgaggatgtatcgtttcaatgcgttgaaatccccgtcgaaatataaataatcattgatctttaatgcgtccggaatgatattatcccctaaggaatgaataaagaacaaacggttggggctgaccggcccccccagataaatcggtatctccggaaattcggcaaactccttgaaaaaagagtttacgataagatccgtttttttattcaagacaaatcccatcgatccgtgttccgtatgctctattaataatacgacggaacgttggaaataggcatcttgtaaaaaaggctcggcaatcagaatacttccttgaataggaaggacatcgttatgtgttattttaaatatatttttataagatgccatgatcgtgaatgttaggttgttactaattcaccgacaatataaggcgttttttaataagaagcaaatgaaaagcccgggattcaagttaataaacgtgaaccgaccgggcttattgttaatttatgcttgatgattttcctcgaataatctcagtctttcgtccagcaaatcatattggtgatcttttatgaaagaggtacaagcccgtagtccttgttggttactacctgtggtacttaatgatatggcgcttactccgtaataaaccagctcttccatcaattgtccgccggtcattcccgggtaaccgatcgtgaaatagaaaccgtcggctatcggttggtccagatcgtgatcataaacgattgtgaaaccatgatccgtaaaaatcttctttagtttctccgcacgacgtccgtattctttcacttgcgagacaaagtcgaacgtaccgtccgcggcggccttgaacatggcggctaaggcgaattgggccgagtggctggttccggaagatagggcgtataagacacggtggatatataccgtaccgaacgtaccgcctccatagcgctgggtcaatcccggataggagcgatggtaaagtttattggagatcgctgtcacgccgatacgctgcccggcatagctgaacgctttggaaccggatatctgcatgatataattatcggtataacgggctacgctcgcttggtaaggaggctcgaaaggacatccgaggtccttgcggaaatccatggcaaaataggcgaggtcctctatgacgatcacgtcgtatttgttggccatctcgccgatgatcttcaactcctcgtcggtgaggcagaaccaagccggattgttcgggttggaatagatcatcgcggcaatattgcctttggaaagatgcgtttccaaggcctcacgcaatcgctcgccacggtattcgtatacgtcgaacgactcatatttatagcccataacggctatttgctgtttctgcacggggaatccggggtcgataaacaagatggtgtcttttcccggcgtacattgtccggccgtaaggaaagaggcgtatgtgccctgcatggaaccggttacgggtacgcaacactctgggtctatatctatatttataaacgccttgataaagcgggaagcttgctttttcacttcgggagttccgttgatgttcgggtagatagacgctataccgttacgaagggcttcgatctcagcgtctacgcctacttgggcggctttcaagcccggtacgcccatttccatatggatgaactcggttcccgtttcttgttccaattgcgtggatatggcaactacctcccggatagtcgctttcccaaaatcgggaagtccaaagccatcgataatccgtctggctgtctgatagtctacaggagtatttttcatgctagtgttaattatatatgggggacaaaagtatgaaatttatcgatttgttctaattttttcatcctaaactattgctaattcaaaaaatccacctatctttgcaccgcaattcaacggaatagcgataaagaataacattttggtctggtagttcagctggttagaatacatgcctgtcacgcatggggtcgcgggttcgagaccaaactttgttaaccttaaatctaatactattatgaaaaaaccacgatgcaaagatacgttcgtcaagaccatttgtcaagtcttttgcaactaatatatgttaagtaacatatcgatgcttgccaaaaagtgttacacaacacaaaactctatatattacaatcaaaatcttctaattttaacgatgattaggtcccttttataggactgctaaagggaaagacgttctttgagtagcttatagccagcgctactggcacgaagataggttccatcctttaatcgtacttgataggtttcttttccgaatagttctactcgcaatatctgttccgtattaacgatataagagcgatgtatacgaacgaactccggagaaggaaggcttcgctcgaaatacttcatggtttgctcctttacgtgctgaccggaagtggtgaataaggtcacatagtcgccacatgcttgcaaatagaatatctcttttatcgggatgatatgaatacgtgtcccgtcttttacggatatacgatctagaatctcctccggaacggtagtcgggggaggtgccgtcttttcctccatttgtctcccgataggttccgcctcactctttctttcccggctggcataccattgggatagaatgatccatgccattaggccgaacaggaatcgaaaaggaatcgtgatcgagaattcctcccaatcttccaatccgaatatttgtagcaagatcgagcatccggctatgcaagcgatttgtacgagtacggcgaaagccactcgtgcttgcatgatatgtaacgtacattgtacataccaaagataatatcccgctacggcgaacaatgcgatggaaagtaagctatcgaccaaagtgatgctcaacggaagatcgccataaagagttaataatgcgcattggatcgctatggctaaaagtaataataggcttcccagccctttatgtaatatggatgttgtaataggatgttcttgcatgatgagtttagtctcttagttcaaggccgctgaacgacaagtctccacatatatataacgtgtgcgtcatgtcggttgtttctgtcaggtccctcatgtcttggcatccagccaagaaggaatcaacctttagacgaaccagccatcctttagggacatatattactacgccgctgaaggagctatctatgtttatgatggtttcatcagcctctaatgttgtttttttaagatcgaggatcacgttgccgaaagatacgtctatgtccgctcccttgaatacggggtccagtacgatgtgccttaccgagttgaaagtggtgtcaaccgatacgaaaccgttatctgtctcgtagttgatctcatcgttaggctttctgtgcccgaaagggggatggttaaaaggacgtttatgctttttcgtgcggatagaatctttccgcttcagcatgatgaccaatcctaacaggattaatcctaacggccaatatatacgtaagaaatcgttcgtgatccaatttaactgcgggaaaaggaaatagactcccacgcccacgaggagcatacctcctaccggattacggtggaaaatcgtaaagatgcccgacacgacaagcagcatcggccaagatacaagcaagtcaaataaggatggatctatcattcctagatttcgcagtaaaaataatataccgacaatgataaataaggtagcgatcagatacccgtttgtcctcttctctttaaaatcgatgtcataatctttcatatccataagttccattttttgttttttatcaaatgtacgggttcgtcattctatacacaagtaaataccgctgatttctatacgagtatcggtaaataaccgaataatcccgattaaaaaagcctttagtttgtaagaaacgtgaatttgacaccaaaacttgataaaaaaacgagtttgataagattagttgataattaaggaatatctttgtctttacaactgcaatagaggaatgtagggaatgatacgaaatattataaatttaaaggcaataatactttattttggattgattttatgcttgatagccggtatgccgactccggcttatgggagttcttcatatccggtcaaggaggaatcgtatgtattggtgataaattcatatgtggatggcgaacgttggtctggtaatttattaaacatgatctcgaagttcgctaccccggaggagtacactctccggatagatcatataagcgtgatgttggttgatacgccagagaaattaaaagagaaacaagaggtcttctttgaagctaacaagaagaagccggatggaattatctacttaggcgtaaatggatgggcttttatgcgggataagatccgggagaaatggggggatattcccactctggtctgttcggaaacgggtgaaatggcagaagatgaatgttattttaatcagcggcattcctctgatagggtgatccctttacaagaggcggttaaggggtataacgctacgggcttggttatcccttattatgttaaaggttcgatcgacttggtgaaggaattaatcccgggtttgaaacgtctgattttcatatccgacagacgttatgtctccacatggcttcgggatgagatggagaaacatatggaaacttctttccctgaggggaaagtggatttttatacggagggttcttgctccatggatagtttaatggcggttctgtcggagaaagacccacatcgagcgacggccgtgatgtattactcgtggattaccgagaaacctttcttgaatcactcgttattatatagtactttgtatcaaggtataaacggcatttctaggcatcctgttttttctttatatgatatgggcgtggaagaaggatatacgattggtggatattataatagctctaaaacgattgagacagctctaattcccttgctacagcaagtttataacggtgaagatatgggcaagatcccggtttcaacggtggatgatcctcataaatacttgaattatgtttcgctgatgagcgcgatgtctaatgaagataatttcccacatgatgcgatctatttgaatgcgcctccctcttttttagaaaaatattggatgccgctattaggctttctgattttctttctggtagtcgtgtttttagcgtggcattacgtgtatcgttctaagcaaaagatgaaggaagtggagttgaggctattatcccgttaccgtgatttatttaataatatgccattgccttatatacggcagcggctgattcgggaaggtacgcaaatcgatgtgcaggttttggatgtaaaccatgctttcgaggaaaaaatcgctcctaaagatttcgtggtaaataagcatggaaaagagatcgctaatttaattgggggaagttatcctttgcttctatcggctgtgcctacagttctggagagtgggaaatcctttacttgtgagtattattttgagccgacagggctttactatacgattatcatcatgcctacctcggaagagaatgtagttgacgcgttttttattgatattacggatatccataaattccagacgcatttgaaagccatgaatcataagctggctatggcgttagaggcggcagatcttttaccgtggcgatataatctggctgaagggaagattatctatgagtcgaaagtacatccggaagataatatagagactgccgagatacatacccatgaggtttcgttgaaggaatatttcagcaagatacacccgtctttcagggcttgcgtggaaaaggctttcgatgatttgtgtaatgggaaaataaagaaagtacgaaaagaatattgtctggagcggttgattccgggagaagatcgccatgagtgggaggagatacaggtaatggccgaatatgatgcttccggtaaaccgaaagcgttgatcggttctacgatatctattaccgagcgtaagcaattggaacatgaccttcgaatggctagggataaggcggaagagtcgaataaattgaaatcagcgtttttagcaaatatgagccatgagatacgtacaccgttaaatgcgatcgtaggtttctctaatatccttgcctcgaccgatgaccttgaggataagaaggaattcgctgatattatcgagaataataattccctattgttgcagttgataaacgatatcttggatttgtcaaagatcgaggcgggtaccttggagtttacttatgactatgtggatattaacgctgtattgagggatttggagcaatcggctcatttgaagaataagaatccggatgtacagatctcatttaaggattatctggagccttgcgtgatttatacggatcgaaatcgtctgtctcaactgatgatcaatctgttgaacaatgccatgaaatttacgctggcaggatcgattttatttggctataagttgaaggatgataatacgttgtggttctatgtagaggatacgggctgcggaatcccggagaataagcggaaagatattttcggacgttttgtaaaactgaatactttcgctcaaggaacaggactgggtttaagcatctgtgagatgattgttacccagatgaaaggaacgatcggggttgattctatggaagggaaaggctctaagttctggtttacattgccttttcagccgaagaaagaattatttcctagtgaagagcagaagcctgttactttggagaagatcgcccgaagtgaggttacgatcttgatcgctgaggacaattccagtaattatcgcctgtttgagtctatattgaagcctgaatataaattgattcatgcatggaatggaaaggaggctgtggagctatttcatcagcacaaaccgcagttgatcttgatggatataaagatgccggtcatggatggatacgaggctaccgcagagattcgtaaggtttctgctagcgtgcctattattgcggtgacggcttatgctttcgcccaagatgagcaacggatcattaatagtggatttgatgcctatacggcgaaaccgattaatgggaagatcttaaaagacaagatatcaactttattgacgcatcggattattctgatgtaatcgaagggctttgcgggaagcagaccttataaaacaattaaagcctgtctcacgacaagccctaaccaaactttgttaaccttaaagctactcgccaagtagcgtacttttcttcaccctactttcggcgcataattatacacactctcgaaacaaagtttgtttacggttgagagcttttctaaagagaaactcttcaagtatatttgcgtagtcttgatagatttatgccctaacagttcactgatcatctcgatcggtacgttttgttccttcaaggtcgtggcgaaagaatggcgaatcgtgtatgaggtaacccgagtacgaataccgatggattccgacagtgttttcaatctgcggttaaaacctcctaatacggtattatattccttgtaggcatcctcaccggtcttcattccctctaaaaacggaaacagatagggcgaatcctcggttgtatcggctgccaactcattcagcagcccttgtgcctccgctgggatctccacctgtataagggatccgcttttctgccgataataagacaagatcccttccttgatatcctcctttcgcaaatgcgctaaatctacgaaagccatcccgcaaaacaaaaacatcaggcaaaaggctgattgggtcctcttctgttgcggatctgtcaccgggcttgtcatcagcaagcgcaggctttccgaaggcaacgcctttttacgtttactctcaacccccgtaaacacattcttaaacaaatgagggatataggcagcctcacccacctctaccgctaaattatagatgtgacgaatccggcgcatataagtagataccgtgttacgagcacatcccttggccaacagccaagattgataacgcaaaagtgtatcccgattaatatacgcataaggaatctcttcccggccacaaaaacatttaaacgacctcaacgcatcttgataactcttcgccgtggaataacgctttttctcacgcaggtaggtgatatacgtaagtacacccaccacaaaatcattctcattcatactttatctccttaagaattaatacataaaaaaatcctctatctctccgttggcacgggaaagatagaggatcttcataaaatccttaaaggaagatattattttccggctttctcagcagcagctttcttattgatcttcttcttctgcaactcgtaagcgatcggagtagcgacgaacaaggtagaatatgtaccgacaatgatacctaataagatagcgaacgtaaagcttcggatcgtgctaccgcccaagatgaagatacacaatacaaccaccaacgtagttaatgatgtattaaatgtacgacacaaggtagagttcaacgcatcattgatcacttgataacgatcacgcttcggatacaaagcgatcgtctcacggatacggtcgaatacaaccacggtatcattgatagagtaaccgataattgtcaagatagcagcgataaacgtctggtctacctccattgagaacggaagaaccttccataacaaggtatagaaagagatgatacagaacgttgtcgttgccacggaagcgaacgcacctacagagaacgatatatcacggaaacgaagcaggatataagcggccatacagatcatggcgaagattaccgccaagatagcgctattcttgatatcgtctgccatactaggacctaccttctgtgaactttgtatgaaagtagtcgtgaactcatctaatgtagttccttccggaagtaaggatttcacgccctcaaacaatttattctcgatctcttgatctaccgtaggatcattatcatcgatcttatagttggtagacacacgtacttgatccgctgtaccgatctggataacactaacagaaccgtctaactgagcgtccagcatattacgaacatcgtctgtcttcacctcttgattgaagcggatcacgtaattacgtccacccgtgaaatcgataccattattcaaaccgatcgtcataaaggagatagcacctaagacgatgattgccgccggaatcaaataaccgaccttgcgagcacccaagaaattgatctttgggtttgtcagcaagtctttcgtcagagaagtcgtgaatgtcacgttcttcaatttatctttcgctaacaatgcctcataaacgatacgagtcaagaacacggctgtaaggaaggaagcgaacaaaccgatgatcatcgtcgtagcgaaaccacggataggacctgtaccgaaatagaacaatacgataccggtaatgatagatgtcaagttagagtcgaagatagcggaaaacgcattgccgtaaccatcggcaattgcctttcctaaagacttaccggcacgaagttcctctttcgtacgctcatagatcaatacgttcgcatcgactgccatacctagcgtcaacaccataccggcaatacccggcaaggtaagaacggcttggaaagaagcaaggatacccatcgtgaagaaaatgttcaataccaaagcaccatcggcgatcaatcccggtaccaatccatagaatgcgcacatatagatcatcaacagcaccaatgccaacacgaaagagatcacacccgcattgatagcctcttgtcctaatgacggaccaacgacgtcttcttgaacgatatgtacggaagcagccatcttacccgatttcaatacgttcgctaagtccttcgcctcttccggtgtaaagtgaccggtgatttgtgaacgacctcccgtgatctcatcgtttacgttcggagcggaataaaccatctcatccaaaacgatagcgatctggcgaccgatattctctttcgtcaaacgagcccaagccttagagccttcggcattcataaccatgttaaccatttgctctgaacgaccggcttgttgcataaagtcagcgttagcatctgttactacgtcaccacctaaagcgggacttccgtcacggttcgttaccttcaaggcatataactcaaagaactgctctttatcatcgatcgcctttacaccccattttaaagccaagttacgaggcaatacctctttcacttgtttcatgttcaggtattcgctgatcttctccatatcttttgcttgagcgatacctaccgtcgaacccggagacaactgaccgttgtactggctaatctgcaataaagcaaataatggatgttgcttagcgaactcttccatgctttgattagcttccgtatcttttttatcttgaccaagctcagccaacaaagaatcggcctcacttacattcgcatcagcggcatcagcgattttctcaacattatcggtaactacagaatcagcggaagcctccttacttaggatagtagccaatacattatcagcggcaaccaattgttgatagatttccggcaacttataagtttcccagaattccaagttagcgctaccttgaagcaacttacgaacacgttccggttctttcacacccggcaactcaaccaagatacgacccgctgtctccaaacgttggatgttcggagaaaccacaccgaaacggtcgatacgagtacgcaatacgttgaatgagttatcaatcgcactttgcaactcttgtttcaaaacagaaacaacctgagcgtctgagctttggggcgtgattttatcttttaactcgaatgtactgaaaatagcggaaagacgtgcgccgctatccaacttcttatactcctcagcgaaaaggtcgatgaaatctttttggctagtcgcttgatgcgcgtaagctaaatccaacgccttgttgaaattctcgtcttggttgttgttagacaacgaacggattacatccgccacgttcaactcaaggacaacgttcataccgccctttaagtcaagacctaaactaatttccatttcacggcattgcttaagcgtatagcctaaccataccttctgagtagatagtgagtctaaataagcactctctttcgcaggatctccacccgcatactcagcggctttactgttgtaatgttgcgtcacgaacgagaacgacaaatagaacaaacagacaagcgtaagtaacaccgcgaagacctttacaaatcctttgttttgcatctgaatcttaggtttatgttattacattatttatattcgttttttcacagggtgcaaatatagactttttttctttgataaagagcaattagtataattatttgtcacgctcatagtttatttcaaacgcaaatgtatatctttggggctaaaataataaggaaaatataccatgaaacagttattattcgctctgttatttatccccgcccagctattcgcgcaagaggatcaacactatctggcaggggccgttccggttgcagacggtaaagtcgtttttacccgagagattaatgccccctctttaagcaaggcacaaatctaccaacaactattaaaatggggacaagaaaattttaacacaaaggaaagtagagtagcttatcaaaatgaggcaaaaggcgagatcgccattatcggggaagaatatatagtattctccagcacagccttatccctcgatcgggcgatgatgaaataccgtattatcattgaatgcaaggaacatgcttgtaccctgcaacttgcgggcatccgatatgaatataacgtgtcttaccagaacgagccggagaaatacctagccgaggaatggatcacggacgagtatgccttgaataagagcaagacgaaattgaaccgtatcagcggtaagttccgtaaggccacgattgacttcgcggataagacgtttgatagcgcagccaacgcattaggcgcacagttgctgacagccgcaccggtagaaccagtatccgctccgcaacgggaaacacgacctgtggcaccgatggaaggtttcgtagcgttccaagcggacaaaatacccagcacgatcctccaaatgttaccggacaacgctttacagatcaaagccgtaaaaggaaatacgaccgacgcaaacgttgaatggaaaggcataggcaatatgttcggtaaaacgatcagtacaatctccatatccaaagatagtcctgcttataaagcgattggcaataacgacgtatatcggttatccttctccaagcccggcacatccgcggatgcgccatggattattatcgagtgccgtaaacaaggagagaccgccgaaggacagcaaacgatgttaatcggcgagattacgaatgtatggatcaaataacgaaaaagagagttgcatttatgaaaaagattctattattaatatatatgatgttccctgtgctagtcatggcgcaggggcataaaggcgaggtagacgaatgcgcccccatgaaaaacgggaaggtatgctatagtgatgatgtagagatcgagaatacctctaaactagaaatattcaacgctattaacgcatgggctaagaaatcttatggaaaagatgtcttcttatccaacgtaaactcgaacaagaacaaagggaccatcttcgtaagctctaaggttgaattattgttgaatgatacagacaagactatcattaaatataaaatgcgtatcacctgcttcgacaaccgatacacgatcgaggcgagcgatatcgtatatcaatacgatccgctaaacgataaaaagtacaagacctataaagcggaagatgtgatcgccaataatggggatagcaatacgatagcgctgatcaaagatcctaagctattctgtaacgctactttcttctttgtcgagaacttgttcgccgacgtatttgacgctgcgcagaacgcagaatccgagtgatgaaacccttttattcaagtttcagataacaccataacgggtagtggtctgaataagcgaccttatccacggaacaattcatagaggtcatgttcggggaatgcaggatattatcgatacggaaccagaagaaattttgattataggtaatacccattccccggccagactcggcaaaggcatccgtcaaatccccttggatcgtacggtgcgcataagaaataggcgtatcattaaagtcaccgcataccaagacataatctcctttcgcgttcttaatctcttctgataccgcttccgcttgcttagcccgaatccggaaagcaggtcctagcttttgctcgaatgctcctttcaaatcgtccaacccatccgagctaaagctctttataagggatgaataacgggtccgatcctccatcgtcagtttaaacgattccaaatggttattaatcaaggtcaacttctttcccttgatgttcacttcatgcacggaagagccgttataatccgaatcgtatttcaccatccgggaattcgacagcggatatttggagaacacagcgatgccgaaactctggaatttcgtggagctttgataaaatacggaacgataaggatacatgctcaacgcatcatagatcttagaggcagtaaggctcttctctgatttagccgtggcatattcctgcaaacaaacaatatccgcgtccgagttagcgatatattggataatcttgttcggagctatcttcgtatgattcttgtatccaaaagccatcacattataagtcagcaccttcagcacctcttcccgagggacatccttatgcgagtgaaacggaaaatagcgtttcacgggaccccaacataacaagaaggagaatatgccgatcaataagaacttccattcccataagaacagccaatagataataaagcaaagattgactacacataagacaggaaaggctaatcccagataagataacgtcatactcgtctcaggagacacccgatccgaataagccgagactatcaacaatacgacagccaccacattcgctacgacgaataagaattgaagaaaaatccgtagagttttcataagtatctgttatttcttactggcgtcgaaaagtcgctttttctcttcagcggaaaggctctcataaccggaacgtttcaatttatccagtatagtatctagatccaccgactcctgatgtttgcgtgcgttatactcataatccgtctcgctacgtttataagtcacacgcatcttcggtttccgtttgcccaaattcacgaaccagtcgatcaaccgattcattggagcggtcaagtcctttccattacgaatacgggaagcgaaccacataccaaacaaagccccgccgatatgggcgatatgtcctcccgcattatcagaagtcatcgccaacaaatcgatcaccagcgtaaagatagccaaataaattaatttgatccttccgatcaagaataaattaatctccaaatccttccggtaaaacgacacggcgaaaacgatcgccataacagatgccgaagcccccatcaaatagctaaaagaggccacgttctggaaataagggaaaatattataagcaaggacaaacaataccgcacccgcaagacctcccaatatatacaagcctcccaactgccgctcactgaagaaattcaagaacaatcccccgaaccaatacaaccaaagcatattgaacaagatatgcaagaagtcaaaatgggtgaacatataagtaaacaacgtccacggacggaagagcaaaagttccggagaagccggtaactgcaaatactgcaagaaaggcaccccttgcacattaaagagcataaacaatacgctggccaaacgtatcaagataaacaagcctacatttatatatatcagtttcgacaggatattacccgactgaaacgtacgcttcaaattagtaaaaataccgtccattgtctgcatctttctttttccaataacgaattaggaaataaccgaataacataccccccaaatgagcgaaatgcgctaccgtatcgccaccaaaactagccacacccataaatagttcggcaagaccataaaatattacgaaatatttggctttaatcgggatcggtatgaacatcaagtataaaggaacattcgggaagatcatcgcgaatgccaacaagattccgaatacggcacccgaagcgccaatggtcacgaaataattcaagaactcgcttttgctgataatctgggctccattcaagtttatcatgtcttggctagcgaagatcacatcccgcaaattaaagaaccataccacctcttgtaccaaaccggcgcctatacccgtcacgaagtaaaaaatcaagaaacgtttggggccccatacgttctccaatacccggccgaacatataaacggcgaacatattaaaaaacacatgcgcaaacgaatgggtatcgtgcatgaacatataagaaacgatctgataagccttgaagtcggtagcacccgggaagtgaagccctaataaatccaccaaatcgatgccgactttcggcagtgcaaggctggctacccaaaatagcaagtttataatgataagatttttcgttaccggcgggatactattcaagaatcccgaatttgtctgattcatcatatactacgttaatttagcggcaaaggtaaatatattttagccgtttttgcccataataatactaaaacatatgtaaatcggtaaaaaaagtaggtttttcttttgtgatatttcaaaataaaactacatttggagccgtctatcggttatcatagttttgtttaatatattaacagtcaaaccatcatgaacaaatcagaatttattagtgcagtcgctgaaaaatcaggtctcagcaaagtggatgccaaaaaggcagtagaagcttttgttgacacagtttctaacgaattaaaagaaggcggtaaagtcgctctacttggcttcggttcattctctgtgtcagagaaggccgctcgtaaaggtgttaacccgaaaactaaagaaaccattgaaatcgcagctcgcaaggccgtgaagttcaaggctggtgctgaattgaacgagctaatcaaataagaaacaccattattctctatagaagaaggatacgatgcaaattgtatcctttttttgtgtaccttcgcgtacaaataaaatccgaattatagttagacgaatatggttatcgaacaacagattaccggggctatcatagccggcatcaaagagctgtacggagcggatgtcaccgctagccaagtgcagttacaaaaaacgaaaaaagaattcaaggggcacttgaccctagtcgtattcccattccttcgcatgtcgaagaaatctccggagcagaccgctcaggaaatcggtgagtacttgttgagaaacgagccagcggtagctgaatttaatgtaatcaaaggattccttaacctgacggtcgcttgctcttgctggatcgatttactgaactcgatcaatgagcagcccacttacggtatcactccggttaccgagcagtcgcctttggttatgatcgaatattcctctcccaatacaaataaaccgcttcacttgggccatgtccgcaataacttattaggatacagcttatcgaagatcatgaaagcgaacggtaaccagatcgtaaagacgaatatcgtaaacgatcgtggtatccatatctgtaaatccatgttggcttggcagaaatggggaaatggagctaccccagagtctaccggaaagaagggtgaccatctgatcggtgacttttacgtattattcagcaacaaattaaaagaggaaacccatgcgttagaagcgaaaggccttaccaaggaagaagccgaggctcaatccaccttgatggcggaagcccgtgagatgcttcgtaaatgggaagccggagacaaagaggtgcgtgcgctttgggaaatgatgaataattgggtatacgccgggttcaacgagacctataagatgatgggcgtagatttcgataagatttattacgagtctcaaacctatctggaaggaaaaggcaaggtgatggaaggcctagagaaagggattttctatcgccgtgaagacggctccgtatgggctgatctgacgaaagacggactggatgagaaattattgcttcgtgcggatggaacttccgtctatatgacgcaggatatcggtaccgccaagctgcgcttcgatgattacccgatcaataagatgatctatgtggtagggaacgagcagaattatcacttccaagtattatcgatcttattggataagttaggcttcgagtttggcaagggattggtccacttctcctacggaatggtagagctaccggaaggtaagatgaagagccgtgagggaacggtcgtagacgccgatgatttgatggccgagatgatcagtaccgcacgcgagatttcccaagaattagggaaattggacgagatgactccggaagaggctgagaatatcgcccgtatcgtaggtcttggctccttgaaatatttcatattaaaggtagaccctcgcaagaatatgacgttcaacccgaaagagtctatcgatttcaacggaaatacgggaccgttcatccaatatacctacgcccgtatccgttccgtattgcgcaaagcggcggaacagggcatcgcattaccggagcagttaccgcttactttcgccatttccgagaaagaagagaacctgatccaaatgatcgccgattatgcggagatcgtgaaagaggcaggtaagctatacagcccggcctgtgtcgccaactatatttatgatttggtaaaggaatacaatcaattctatcacgatttctccatccttcgcgaagagaatccggaattgaagaacttccgtttagtcttatccgccaatgtagctaagatcgtgaaatccggtatggatttattaggcatcgaggttccggaaagaatgtaacgatagaagatgaacataaacgagaaaacaagaaaggctctccttcgatttcaacaaaatgaaatcacggagagccttctctatacgcaactcgccgctatcgagaaagatccaagcaacaaggaagtattactacagatagcgaatgacgagaaaggacattatacgatcctgaaaaagtatacggggcaagagatctccccgaataaattacgtgtcactaaatactactggttggcacgtatcttggggattactttcgccattaagctaatggaaggtagcgaggaaagcgccaagaatgattacgcctcttatgatgagtatccggatttgcaacaaatcgcacgtgacgaggatgagcatgagcagaggttgatcgccttgatcaatgaggaacggttggaatatatgggttctgtcgtactggggctaaatgacgctttagtagaatttacaggtgctttagctggctttacccttgccttgagcgactctagattaatagcgttgaccggaagcatcactggaatagccgccgcattatccatggcttcctccgaatatctatctaccaagtccgagaatggaaatgaaaacgggaaacatcctgttaaggcatcgatctatacgggaatagcttatatctttacggtagtcgccttggtcgctccatttatctttatatcgaacgtattaatggctttagggcttatgctcatcatagcgttaagcatcatcgcccttttcaactattattattccatagcgagaagcgagagtttccggaagcgttttaccgagatggcagtacttagttttagcgtggccgcattaagcttcttgatcggatatgcgttaaaagaatttacgggcatcgatgtctaaaaaaatcatagttatgttttgaaaaattcatagttatgagtttagtaaatcataactatgaatttttagagctataatcaagcctttttccgtgtcgtacgtttcttcgtcgcagcaggtttttctcccgcctcggcgattatcttctggcattcctccaaggtcaagttctctggtttctctatcgtcttaggaattctgtaattctttttcttataagagatataagggccgaagcgaccattcaagatttccatttccggatcctcatcgaacttcttgataaatcgttgctcatctttttgtttttttgcctcgatcaactcgatagcttcctcggctgttatcgacaaaggattcaagcccttcggtatggatacgaactttccgtcatgacggataaatgggccaaaacgtccgacagcggcaaccatgaccttaccttcatattcaccgatcgtacggggtagatcaaacaatttcaaggcttcttccaaagtaatcgtctcgatagactgccccttcatcaaggtagcgaattgaggtttaggagcctctttatcctctgggtgcgcctgcccgatctgtacgactgggccataacgaccgatcttcacgaaaacaggtttgccgctcttcggatcgatacccaattcacgctcacccactttatgctccgtacggacagaggctgcctcttccacgatcggatggaatagtttatagaatttatcgatcgcgtccgtccataccatctcgccttccgctacggcatcgaattccttctccacgctcgccgtgaagttataatccataacacccgggaaatactccatcaagaaatcattcacgaccgtaccgatatcggttggcatcaacttattccggtccgctcctacgatctccgtcttttggacttccttgatcgtatgctgagccaaggttatgatattataagtacgctccgttccttccttatcccctttcacgacatactcccgattctggatcgtctggatcgtaggcgcataggtagaaggacgaccgattcccaattcctccaaacggcgaaccaaacttgcttccgtatagcggggaggacgttgcgtgaaacgttcggtagcgacgatgtccttcatactcaatacctcgttcaaggtaaccggaggaagaaggccgttttcctgttccttctcattctcgtcatcaaaactctcgcggtacacctgaaggaaaccgtcgaaagtaatgacctcaccggtagccacgaacttctctttcttgccgccgatgcctacggagatcgtcgtacgctccaactcggcgtccgccatctggcaagcgatcgtacgtttgcggatcaattcgtataatctcttttcctgagcggtcccgcttatctcatcatggctgatataggtcggacgaatcgcctcgtgcgcttcttgcgctcccttgctcttggtatgatattgacggaatttataatatttctcaccgtaggtatccaagatagcttcttttgccgtccccaaagccaaatcacttaagttcacggagtcagtacgcatatacgtgatcaatccggactcatacaggcgttgggcgatcatcatggtctgcgagaccgaataccccaacttacgggcggcctcctgctgcaaggtagatgtcgtaaaaggaggggctggtgtcttacgcaccggctttttcgagatatcatcgatcgtgaaagaagcgtccttgcaagattcaaggaatgcctccacctcttccttatctttcaaacgacggttcagctccgccttgaggattgtcgtaccatccggcaagataaagctagcgatcacacggtaggcggcctccgagacaaactcgttgatctctcgctcccgctctacgatcagacgtacggcaaccgattgcacgcgccccgcggataaagccggcttcaccttacgccaaagaatgggggatagctcgaaacccacgatacggtctaagatacgacgggcttgctgcgcgttcaccaaatcgatattgatatctctcggcgtctcgatcgcatgtaatatagcgttcttggtaatttcatgaaaaacgatacgtttcgtattctcaggtttcaatcctaatacctcatataaatgccaagagatggcctctccctcccggtcctcatcggaagccaaccaaacctgctcggctttcttcgcttcgttcttcaattcggtcacgagtttcttcttgtcagagggaatcacgtattccggggcataattgtgttcgaggtctatactgaaatctttcgttttcaagtcgcggatatgaccatagctagacataaccttatagtcctttccgaggaacttctcgatggtttttgccttggcgggtgactccactattaccaaattcttttgcatatctattttttgctggttagaaatcgggtgcaaacttacacaaataattaacgtacgcggtatatcggtcactaaaaaagcgttttttcctatacattatatatatagtcactcgtttctatttaccttcgcgagacaaaatcaaaaggttattcaaaaatatggaagagataaagcgacttatttcagagaataaactagaagaagcgatccggctcttggacgcttacctcacggagcaaccgagatccgacgaggcttggtttctcctcggaaaagctcattataaactaggcaacgtacgcctagccctcaacagctacctacaagcgatagagatcaatccggaaagcccggcacaagcggcctacgatatggcgatcaaggtgctggatttttataataaggatatgtacaaccattaagaagacagagcacccgtacccaaataaattctagaagtacaagtaactcgactttatgcatttatgaagttagttgttattgatatagcgtttatttgtataatgctcatttacaacctataacgtaagctcttcataataggcatcgttaaaggcttacaatgggcattataaagtgcttataatgggcaatgttaggtgctaagaatgcccatcgtaatttgtagagacggggcgtgccccgtctctacaagatatacaatgaatttatgtttctttagatttcaatcttccatgggagtaatcgtatagtcatgcagacagaagaattcctctgtcaacatagtaggtggaatctttccctcttccaaggaatagcccactccactgaaacgaacattcagcccctcctgctgataagccatcggcatatcctccacatagtaattacccacgaaatcgattggtttggaacaaactatggcccatagattcacccgatcgtcccaacgaatacgaccaaactcatcaactagatccgtccttcgcccatgctcatgcttatcctcatgctcatcatcaccgcaagcggtaaagcctagcatggtaatagtacacaggcaaaatgataaaaatacagaaaatgcttttttcatataagtaaactttaagaaattacctttatccaaatgattatcctttataagtcagcgccaacatcgtaatatcatcgctctgcatagcgccgttcacgaatgattggacggattcggatataccttcgatcatggatttgggggattggttctttacggagctacaagcctctaccaaacggatatctccatattgctcattccgcaggttcatcgcctcactgattccatccgtatagaggaacaagctgtctcccgcttccagtttcaaggattgttctttataagctaatcccggcacgactcccaaggccatcccaccagtcatcggcaaaagagataccttatcgttcttacgaatccaaaccggacgattatgccccccattgcaataaaccacgtcgcccgtatggatattcaagatcgcataaaaagtagtgacaaacatcccattgacactctcacggcacaatagatcattcgattccttcatacagaccgccggggaaagctgcctaagcgccgtagcacggatcaccgtacggctgatcgccataaaaatagcggccggaatccccttatccgacacgtcagcgatcgtaaaacccagatgattatcgtccaccaagaagaaatcatagaaatcaccccccacggctttcgccgcactcatggtcgcataaagatcgaattgcttatattgcgggaacggagggaactgcttcggcaaaatcgattgctgtatctcacgtgccacgttcaagtcatattgtatctcctctagctgatgatgttccttttgggcctccttgataaaagaaatctgctcgaccgccttctcgatcgtacgttccagatcttccatatcgatcggcttggtagcgaagtcgaaagcaccatggttcatggcggtacgaatattctccatatccccgtaagccgatacgatgatacatttcaaggccgggttacgcatctcgttaatcttcgtcagcaatgtcaagccatccatctccggcatattgatatcactcaatatgatatcaaagtccggatggtccaacatcatcctcaacgcctccaagccattatgggcaaaggagaactcatactctcccttacggatcttccgacggaaatattgggttagcaacgcttccagatcctgttcgtcgtctacgcttaatatcttgatcgccataattcttctgtttatttcgttaatggaataaggaatatgaaacgggtaaactcaccttctttcgattccacctctatcttcccgtcatgcttctcctctataatggatcgagtgatagatagccccaagccagttccctctcccaccggtttcgtggtgaaaaacgcggagaatatctgctcccggatatcctccggcataccgataccattatcctcgatacttaatcttaaagaatctccctccttccgtagatccacggatataaccggctcatacccgatcggcgagagcttggatttactatagaccgcatagcaagcgttattcatgacattcaataccgcacggctcaaatcctgtgggatcactttcagcatcggaagcccttcctcgtaatgctcccggatcgcgatattgaaacctttatagttcgctcgcatcgaatgataagccagccaaacatattccttcaccagattcttgatatccgtagggatgtactcgtcatccttccctctggaataaagcaagataccccggatgatacttgtcgcccggtttccatgttcctcgatcttcttcaagttaccatgcaaatcgctaacgatttcgcaaaactcctcatgcaaggcggtcagcttctcccaagattccggaggcaagacatctttctcttcttctaaaatatcttccaagtcatccactaacttagaggacagcttactgaaattgatgacaaagttgagcggattctggatctcatgcgcgatcccggcactcaacatacctaaagaagataatttctctaagttcttcacttgcaaacgtagccgttctatttccttactctggtcttccatatctattcctcctctttaggcggtgtaattgttttcggttgatatacagggatcgtaattagaaactgggtatattctcctttcttactctccacctcgatggttccccgatggttttgcacgatctcacggcataggtaaagccctacgccggccgcttcccccgttgtctttgtcgtgaagaaaggagcgaatatcttatcttttatattctcgtcgataccggacccgttatcccggatcgttatttccagcatatccttattgactttcaatccaaggaatatctccggactaaaagtcacggtctccgatttcttcaacagggcatacatggaatttttcaatatcccggccagaaccttactgaactgctccacgtttacctccatcatcaaagacagcgtcaaattatcgaaaacaatccggatattcttctcttgaatatcctgctcatacgttttcttcaatttatccaaggcgatccggcataatccgtttatgttggtaagcgtaagattacctcttcggtctttcagcaattcctccatcgccttaacgatacggaccgtattgaaaccatgctcggagatcttctccaaattactggtcatcatattcagcaaatctaccgagtcgtcatacacatccggtttcagatgctctttctgactatccagattttcccggagatccttggccaaccccgatgtcagattcgcgaagttattgatataattcagtgggttcaagatacggtccaccaaaccttgggtcaattgccctacggtagccatccgttccttacggaccagctcgtcctgcgcctcacccaaggctttcaatgcggccgccaatttctcggattcctcttggatcgcatctttctccgaacggatctcctgcgtacgctcctctacctcttttaccaaatactctttttgtttgagtttccgcttgaaaacgaacttagagatctggcaaaacagaatcaagaaaagtaatccgatccattcttgatgaccgaacttcacagatacacaaataccgaccaagctacccagtgtaacccgttcgcaaagtttaatccgcctttttaaccgatcgatctcggtatgtaaatcctgtatcatgatgaacctcctttcctaactataaataggcaacgtaatcgtaacttccgtatatttatctttctcagactcgatagcgatcgtacccttatggttcaacacgacctcccgactcaagtaaagacctgttcctgccgcttccgcggtcggtttggtggtaaagaacggagaaaagactttcgtctttatcgtttcttctataccgacgccattatcacggataaccacttgcagcttatccgcttgaatacgcaataccaacgagacagaaggctgatatcccggctctccggcctttttcaagaccgcatatatactattatccaatatctgcgacaaggcttttcccatctgatcgatattcacctcgattgtcaacggtacggaaagcccggagaatgatagatctacttgattcttctcgatctccttcgcgtaattctttcgcaagatatccagattgaccttacataaatcattaatatccacgcaagttcgattcgccgaatgatctttcagcaattcttccatcgcttttacgatccgcaccgtgttatcaccatgcttggctatcttatccagattgctggtcaaaagaaccagcagttcttgcgtatcattataattatcgtgtttaccggtctcttcgtcctcatcgatattctgcttgatatctttcgctaatacagcagacaaatgagcgaagttattgatataattcaagggattcaagatacggtctaccagacctttcgttaattggccgatcgatgccagacgttccttacgaaccaactcgtcctgggcatccgccaaggcagaaagggcacgggatagtttttccgactccgcttgcatcgcatcccgctggaaacgcaattccatcgttcgctgctccacgagattagagacgaactgtctttttcgcagacggaattgcgtataatactttaacaggaatagaaggactacggctcccaccaaataataaaccagttcttccttcttctggtaaaccgccaaggcgatccacgctgtcccgatcacggtcagcgtctcgatcacccgcatcctccagcgaaggctttccagttgtttgatatttatgtcacccatccttcctatttcaagtgttagaaattgatattaacgccaatcatcgcactaaagctttgcaaaggatatccgtaatatacctcatacttctggcaaaggatattattcaacttagcgtaaacaccaaaggtatcgttgaaggtataggtacctgttaggtttagctcgttgatgttgttcatcttatactcgcccgctccacctaattgggtataacgtccagtagccaaataatagtccagcaatacggagacattctttaccggacgaaccgtcaagcctgccgtcacttccatctcaggtttgccccaagcatgggctagttccccgttagcttccccaccaatccatgtatcaccaaaattcgctttccaattattatatactccctttaaagacacatcgaacaattgttgataactatacttcaagttagcgccaataaaaagctgtttcgtatcgatatcagacatagcctcgctgaaattcccgaagtgatctctatcataaattctcgacggcaagaaaagcacatcgctgctcgttatcttataaccggcgaacacatcgaaccaaaaaccaggagccacgccactctttatacctaaagtagcatccaaccaattacgggagggggcgatctcttttgtaggatttacataacgattcaccaaagaggtctcatacatactattggaatataacttaccaccagcgtttaagtaaagcaaggtcttatctgccacctctatgtctgccgcaatattgggtgaagccatgaacttactattatcaccggtcaccaacatcacattagcacccaatttcaagttccagctatccccctctaccttataatatggggaaaggattacttccgcatgattctcgaactcataagtataataggtacctgatgtagtttctttttttccgggtaaactatagttaaaatactctacctgtccacccaagccaatccgcatattcccgttaaaaccggcattcaaatcgaatttagcgtcaaaagtatgttctgtaggaccatccgctggtttgcccagcccgtatttatgggagaaatttatataacctaaatccagcaaatatccgaacggggcatcttccttcgactcaaatccgatattagcagctatcgtctggtttacttggtttgtttcccgatccactctatccaaactaccctctgccatcatagaccaagcatccgcaataggcagtccataataattaaacgccgaatatccgtacttcgcaccaatactaaatatcgtcttatcaaaaacatgcttgaaattgatgcctcccagattatcgttgatcttcgccttcaccttctcatcgtccatctgaatatatttcacctttccattcgtagaacgatgtgaataccaaatattcaacttatccttctcggtactcaagatatgatatcccaaatcaccgtttatattcagatatgtgcctacaccgaagttaaaatatccccggcgcttgttgtaatccatctgcgtcatgatatttccggaaggcaacaaactaatctctttctgcggatcggcggcgatcgtataattcgagtaatcgatcgggatcttacgaacctccggctctttcaccacgggaagcgtatttaccttgctggcgtcctgcacggaaggatcatactcccgttcaagcgtcatctctcggttcaggttcttttctttcgtaacatcctcttgcgcactcgcagcagcagccgaacccagcaaagctaccacacacaacgcctttacattatatatagtcttcatcgctttcttttatttctttagtttacccaatctgtcttcgatcatcgcggcgatctcatcatcgcccttgtagttgttttgcaaactggtcagatattgacgagcttggaaatcatcaccttggcggatataaatatcagccaacaagataaagccccgtgccaaccaatattggtgaggcgtaccgttctcgatgaagttcatcaagacagtctcggcattcttatcatccttattatcataatacaattgagccaatagatatttagcctccgccccgtgtatcgtacgggtatccttgctgatctctttcaagtcggccaacgccttgttctcctgcttcaagctgatataagccttcgcacggacataacgggcctcggacataatctcgggagatagcttcggttccttcagtaaatcgttggcggcaagcaaagcctcttgcggctgaccggtcaactcggcgcaacgcatcaagcccaatttagcggcctccttattctccggattctccgctaccgcctgtaggtgtttgaaactttccatagcggcggcgtaatccttatccagatactcgatctcagctttacgagcccaagactcttccctgaatttcgtatcaccgctctccaatactaacgagaacaaacgtttcgcctcctccagatctttcttggcaaaagcgatacttgccaaatagaaattagcgttcgagctaaacgctccctgcgggaaggtttgcaaataattcgtcaagctacgacgagcgccctcattatcgcctcgcataaataacttctcggccgccaaataggtcaaggagtcttgctcactcacctcgaaacgaacatttccacctaatgaattcgcataggcggcaaacgaattgatatcgttcaactcgatatatacggacttcaagtcttgcaaggccactttcgcctcctcgctacccggataattgctaatcacgctcttataagcctcggccgctttctccggctgattgtcgttgaagtaaatcaaaccaagctgtacgccggccttacgagccagactgctttgcgggaaatcacgcatcaattgctcaaagcttgccgcagccgcttgattattatccaataacacgtaagaacgtcctttctcgaacaaggcatcgtccacatattgtgattccgggaactcacggatcaaacgatccatcacgctgatctttcccttataatctttctgcaatcccagcaagaagcccttctgatacaccgaataatctccggcggacggttgcaattgcgccgcacgggtataattctcttccgccatagcgaactgacggttgtggaataaacaatcgccgatacgattataagcgtccgcataagccggagtctgctgattgctttccaaattcacgtattgacggaagcggttcaacgcctcgccatactctttcaatttgaagtagctgtaacctaagttataatgtgccaaggcatacatatccgtattacgttggcgggtattattcaaataggtacgataatcggaaatcgccttgttatactcaccttggcgataataagattccccacgccagaaataagcgtcgttacgagattccagattataagcgcccaacgaaatcgtacggctgaaaagatcgaccgccttatccaattccatattcgtgaacgcctgcgttcccaactggaataagatatcttgcttcgcctccaagatcttcgtgctcggatgcttgatcttatcgatagagttcagagccgcttgatagttcttggtagtcaaataaacctccaccagataatcgtttaccttatcggcatatttggaattcgggaaatcattcaagaaatcctcgaagattgtcaccgactcgccaaagccagtgaaagcggtctcgtggatcaataaagcgtaattatacatagccgcctctttcacttgcttatcgaaagaagaagtcgcggcagcctcgaaggccatacgggcgttattcttatcttttaatttcagataactttgccccagatacagataagcgttctgcgaaagggcatcgttctcacgtacggtccgccccaaagcgttcacggcgctactgtaattacccttattgtaataacatacgcccaagatatataaatcgcccctcaacgggctatccgtcgaggatacatatttactcagcatattaatcgcctgatcctcatttcccagatgatagtaggcgttacccatgatacggtaaacctcgctattgttctcgctatccggataagaggctagcaattccttaccttcgctgatcactttctcgtatttattctggataaaataaatttgcgtgatatagtacaaagatcgctccttataatcaggcaagtccttcaagcgggtaaattccaccaaggcattgttgtatttaccggttgcgtaatcgatataagcgacataataggtagatgcttcccggtacttcgttccgatctgctcgatccgtgcgaaataaccacgggccttctccatatccccaatttgcaacaaggaataagccaaacggaaacaataaacctcctgttgttccggacttagcatatcaatgttcgattcgttaaaccaaaagatagctttctgatattctccctgtccgaaatgggcggaaccgatcaagaagttcacctcgtccgcatgacgggaagccgggtacacatccagataatctttcaataactcaacggcattgggacggccttgctcataagcggagtagaccaacatataatcggcttcttgaatcaagtcggcatccgtggaatgctgtttatacgcctccagcttatcgatgcaacctgaataattcttcaaactaaacaactccttgccttcgacaaacaaacggttcggcgcatcaaattgatacgatctctgcccgcttgccatgtggctgcctactaccagacacagcggaataagtattcttttcatcactcatttgctttttaatacaagcacttacttcagtgcctattcgttctaattcgcaaatataagtaatatgcgccaaacagcaggcaagttctatcaatatttaccaagatagatcggtaccgcctttcggatagagtctaaaccgaagtcttccggattcacatcctccgggtgaaggatcacgatctcggcggcatcatcttccgcatgcacgttattgaaatcatctaccaaacactcataaaacatatccagcgtatgcacctcaaagccggaatacatatataaattaggcaaggaaaacaaataacgacaattctggatatgcaaccccgtctcctcccttacttcccggcgagcggcctcctcccccgactcaaacatatcgacgaagccaccgggcaaatccaatgtacccttagccggctcttttcctcggcgaaccagcaataactcccccttagcgttctttatgaaacaagcgacagccgacgacgggttgaaataataaacaaaaccgcacgccatacattttttcgctttctcgttatgttccacgaaagcttttgccccgcaaaccgggcaaaactgaaattgatacaacggatgtctcatactttatgatttataattcaattaaaaacaacaagccgcacctaaatatagatgcggcttgccttatttcgcaaatgtcttttcgttatacgcaaaaccggatttagacttccaaaccagcgctttggtctcttacttcccaacccaaagcacttgctcctaatacggcagcatcgctctctttcaattgagagaataataatttagtcttacctgcgtaaactttcaacatatttttctccattgaacgtttaatcgggttcatgatcaaatcaccagctttcgtaagaccgccaaacaaaatgatagcctccgggctagagaatgctacgaaatcagcgaaagcctctcccaacatagagccggtagcctcgaaaatctcaagagcgatcttatcattcttcatagctgcgtcgtatacgtcttttgaagtgatttcatccggatccaagtcgcgaagaacactctcgtccttacggatttccagatattcacgagccgtacgagccacaccggtagctgaagcataagcctccagacatccttggcgaccgcaaccgcactgacgaccattgttacgacgcatgataacgtggcccaactcaccggcaaaaccgtcatgtccgtataccaagttaccaccgattacgataccgctacccacgccagtacccaaagtgatcacgataaaatctttcataccgcgagcggctccataagtcatctcaccgatagcggcagcgttggcgtcgtttgttaaagcaacaggaataccatcgatctgttcgctgatcaattgagccaaaggaatcttacctttccaaggcaagttcggagcgaattcgatacatccgttgaaaaagtttccgttcggagcacctacacccacacctttaatcttatccggaccaccagcctgatcaataacagacttcagacctttagcaagttccgctacatagtcattaacgtctgcatatttaccagtcttaattgatccactatacaagattgttcctcttgcgtcaactacaccaaaaacagtgttggtaccacctatatcgatacctactacataaggcttctccatgattttatatttaggattaataatgattttcctctttctgggtagcaaatataagaggtttaacacaagttgcaatacgatttgaagaaaattttacagattcctgtcattttatcttcttttttcgaaaacttatgttaagcaacattgttatataataatggagaattatcgcaacggtaatatctcgatccaatagtcatccggatcattaataaaatacaatcccatcttggtattctcgaagcaaaccgctcccatttccttgtggtatttacgtacctcctcataatcgccggctacccggaaacaaagatggctctcattgtcgcctagctcataaggttctttccggtcacgcagccaagtcagctccatcaagaaaccggtttgctcatccgttaaataaaccaatataaaagaaccgtcttccgcgacctttcgatgatgctctttcaaccccaacgctttgttataaaaagcgatacttttctccaaatccaatacgttaatattgaaatggtcaaatctgcctttaacttccatacctaaataaatttatatgttttctaaaacctatacattaataatatattatatatcggtaccctcacccggtacagaaaggacaacataccggcaacctttcgattcggcatacggggcaaaagccatgacctccgccggacgttcccagaaatgcatcggcacaaagataccggtctttatccggtcgatgaattgttgggcacctcgcataaaatcggtccctaagcggggatctaccggaaacatgacaacatccatcgcctgcgtatatttcgctattatatccagttctttcaggtaattcccttccgcctccgcaacttcctgtggagtagactcatctttccaatgccaattattcaagtctccggcatgaaaaatcagtttaccttgcgcctcgatcaaaaaagagataccgacatcggtcgatccgaacgccctaatcgttaaatgctcatcttggtacacatctcccttcttcatataaaaagcgtcctcggcttttgcccggcggcgtttcaagatatccttggagaaaatatatttgatatcgtctttctcctctttccatttcaacacgtccggattaaaatgatccggatggaaatgtgatgccaagacgtacaacgtccccggacgttttaatagctccccacgcacaaaccccttcgccgggcccggattcgtatctttgaaataatcgatcaagatggagaagccttccgcctctacaacaaacccgctatgataaatatacaccagtctcatcctattctctttatttgtttattaaaaaacaccgaaaccctccgggttgttgacttcatgccgcaaatatacaaaacggtcagacatatcacatgcctgaccgatacagattattaacctacgatttatttccaattctcattctggactaaaacgccttccatggtcacgatttgatcattcgggatcggaagagttacccatttagcgttataaacgcagttggcaaactttccgagatgcctcttctcgtaagtgatataattacttatctcatcgtacgctattccccaacgagctaagtcgtaccagcgatgaccttccatcgccaactctaatttacgctcgaaacgtaaagcggctaaagcaccatccttgctgttgaattgcgaatccggatacaaacctacacgataattagccgcagcgttcgaatccaacttcccattcactttatcatccaagacataagatgtagaagtgggcaacatcgtggcagcatcaacgcccttcacatacgagtttgccgcacgggcacgtacctcatttatatacttcccggcctccttataatttccgtcgtgaatcaagacttcggcataccaaagtaaaacatccgcataacggatcaaatggtaattcttggctgtagaactcgtctccgtagatacgctcgtaccgcctttatccgcttttttcggttgccgcttcttattcatataaggaccaccattcgcgatatcacgtacccacccatccaagatagaaggaaccgtccagtcccaataagggacatcaaaacgaccggtactgatatccagacgaggatcggtaaaaacctctaaatccgtatgtggaatattatctgtcaaggtagtcaacgccggtttatcttgatatgatttatccagatacggcaaaccattctcgtctacgatatgtgagtttaccaactcataggaaggttgatagaaaccccatccggatgtgcccatacctcccggaggagccgtatgccatgaaccttcgatagagttcgtgattacctgagaaccagagatagtccgctgtatatcgaacacggactcaccgctccaatcggcactacctgccgtaaacaaatcctcataagtatccgctagtttgaatttcgtgccattattatcctgcccattcgcgataatagcctccaataaagccttggcatccgcccaatgatcggaagaaccattcgtaccgttatagggtgaagactgatacagcctcaattttgccaaaaaagcggcggcggcccatttattgacacgtcctttatcgctcgcccaaatatccggcaggttatcataagcgaactgtaaatcctcggccaccttatcccatatgtaaatataattgccagactcatccacattggaaacttttgggtttacatcgctagcgaattcctcgcttcccacgtaaggaatagcggcaccaaataatttcattccctcaaaatgccagaatccgcggaagaatcgggcttgggcgatcgcttcggtataaaaatcctttgatacgccttttacggaagaaagctcgtccttgatcttatcgatcatattaatcacgttgttcgcacgatagacaccttcataaaccactttccatttggtattcaaatatccgttgtccgtagtgatcgcatacgtttccaagttcgtaaagtcagactggtccgtaaacgtagaccctttattcgcgcttccacccagtacatcgccataggcataatttgtcaaaggagccgcaaaatactcctgtgtaagcatcgatgaatacattcctgtaatcgcataatttacgccttcctgattcagtaactcttcttcactgaccgcacccaccggcttcacatccaagaagtcagagcaagaggtcatcgctcctaatgaagacgccactaacattgaatatataaatagtcttttcatactgttttttttaatcgttatcaatatccttatcgaaaatccttttagaaagaaatattcacgcctaaaatgaactggcgtggcataccataagaaccgtagtcgatacctttcatcatatcgttactgctatcttcattattgctacgaacctccggatccaaacctgaatagcctgttaatgtaaacacattggaaacctgaccgtaaacacgaatcttctcaaatttgatcttattcaagatactctttggcaacgtataaccgagcgtcaatgtctgcatacgcaagtatgaaccgtcttctatataagtagaattggattcattagccgcctccgtaccttcattagatgtaccagcccataatggatagataccatccgggtttgtaacgggatcccaagagttttccaagcgatctttagagaagttactttgtaatgccccgaaatgcgtataatactgataatgtttatacaagtcgttacctacagagaaataaaggaatgtactcaaatcaaaacctttccaaccaacactaaggttcacacctcccgtgaagtccggatgcggattaccgataatcgtacggtcttccgccccaatctttccatctccgttcacgtcacgaatcttataacgacctacccatgattgaggattcaagctggcctcgtccgccacggcatacggtaaaatcgtttttccatccgcggtcttatagttcagcacatcttgttcactcgtatagattccgtccacttgataaccgtagaacatcgctaccggttgaccaaccgtggtgatgtttaccttactcaaacgcgtattcgtaaatagatccgaggaacctaattgggtaaccttattcttataggttgagatattggcgtttaccgagtaactaaaatcaccgactttatctctccagcccacactgaaatcaagacctttattctgcatatcgccaatattgatctttggcttagtagcgttaccggccaaagcggaccagttagcgttcaccaacaaatctgaagtcttcttaatataataatcgatacttccggtcaaacgattattcaacgccgttacgtctaaaccgacgttaaacatcttggttgtttcccacttagcattcacatcacccagatttgagatcgcatagcccggagacgcccctgaatccgcacctgtgattccatataaataatcatttccggtcgcatattgaaacgcataattataggctccgatattagagttaccggtcgttccataacccgcacgcacctttaaatcatccaaccacgtacgtgtcttttccataaagacctcatccgacatacgccagcctaaagaaagagaagggaatgtaccccagcggttatcctcgccaaaccgggaagaagcatcccggcgaaccgttacagttgccaagtatttacctttataggaataatcgccacggaaaaacaagccgaacatcgtacttttatcaaacatttttccttcattcttcatattgtcggaagaaccattgtttaatatccatgtattgggattattctcgaagatataatcatagcgaatggctttcatacttcgtcccacaccaaatttcatagcttccgtaccgatcataaatgtcacgtcatgatcttcattgaatttcgtcttataagtcgccgtattggtccactgataatccaacctccaattcgcgttttcctccagataattttgagattgcccctctttattggtagcgatcgtcttctcactcaacgcttggctccacatacccatcaaacgaacactgaactgcgtacgaagactcaggcctttgatcggtttcaactcggcgaaagccgcactttgcaatcgcatgaaacgagtccaatcatcctgttgattcatggctgtctgataagccgtattcgcacgtccaccttccgaggcctgtgatcccgcataatcgccacctacattataaacaggtacccatggctggatcgtatatgtttgggcgaatacgctcgcatccccttgacgaccccgctcaccgcccatctccattacggcgatattggaattctggcctatcgtgaaatatttattcgcgttataagtagagttggcacgcagtgaataacgtttaaagaaagaagagataatcgttccttcccgattagtatagcctaaagaagccgagtaagttcctttctctccacctcctaataaagagatctgatgatcctgtactttacccgtacgagtcaccatatcataccaattcgttcctttctgggcctccgcttccgaatatccatcttccaacatctggtaataagcggagcgtgaccacgaattactaccatccggtttataggaagccacccacgcatcgatactaccaaactgcgagattacttgatcttttgataaaccggccggtttaatcgcataaggcatcgtcaattcatctttatcgttcaacgatccgaattgaggatgagcggtgggtgtttgtccgcgataatcccgcacgtttctcataccttgtgcttgccattccatcgcctcccatccattcaacaaatcataaccactattcgccatcttcgccacaccaaagtaaccatcataagatactcgtacccggccgcttttagttccttgctttgtcgtgataatgattacaccattcgctccttgcgcaccgtagatcgcagtagcggaagcatctttcaagacttgcaaagactcgatatcattcggattgaccgcatcgatatccacattcgagacaccgtccacaacaatcaatgggtccgaaccattcaacgagccgacaccacggatacggatagtcgtctcaccactaggtccacccgagttcgagatatacacaccggaagcctttccttgcaaggcttctgagaatgtcgctaccggagtctccttcaactcttccgtagatacgacagcgacagatcccgtaatatctttcttcgcttgggtaccataacctacaacaacgacctcatccaaggcttgtgtgtcttccgctaattttactttgatattgttctggctattcttcagagagatctcttgagttacatagccaatgtaagataccaccaatatggtattatccggcacaccatcaagtatgacccgtccgtccatatcggaaatatttccgatagttgtccctttaataaggacattcgctccaacaattggtccagctttgtctgaaatagtgcaagtgactctacgtccatcttgttgcagggcattgccccttacgtctggtactaaatcgcctacttctgtggccataactggacttgtgccacatagaaacaaagaggctcctagaaacacctgtttccataatactacatttctcatacaacattagattttaaggtataaatcaataaaaaacacaatctaacagcaaaatgatctttctatatacaataacattctagatttcagcaaattcttgaatacttatggtctaaatgttttttcataaaacgactaatcgaaacgatcgtttattagtaccactcggctcggacgtcgccgcccttacacctgtggcctatcaaggtcatcgtctataaccacccttgagggagatctaatcttgaggccggcttcgtacttagatgctttcagcacttatccgatccgtacttagatacccggcggtgcccctggcgggacaaccggtaaaccagtggtacgtccaacacggtcctctcgtactagtgtcagagcccctcaaatctcctgcgcccacgatagatagagaccgaactgtctcacgacgttctgaacccagctcgcgtgccactttaatgggcgaacagcccaacccttgggaccttctccagccccaggatgtgacgagccgacatcgaggtgccaaaccattccgtcgatatgagctcttgggaatgatcagcctgttatccccggagtaccttttatcctttgagcgatggcccttccatgcggaaccaccggatcactatgctctagtttcctacctgatcgagttgtatctctcccagtcaagcgcccttatgccattacactctgcgaccggttaccaatcggtctgagggcacctttagaagcctccgttacgcttttggaggcgaccaccccagtcaaactacccaccatacagtgtcctcctgcctaggagttagaactcaaacaaccgaagggccgtatttcaacggcggctccaaggatactggcgtacccccttcaaagcctccggcctatcctacacatcgtctgcccaaattcaatgtaaagctatagtaaaggttcacggggtcttttcgtcccatcgcgggtaatcggcatcttcaccgatactacaatttcaccgagctcacggttgagacagtgtccagatcattacaccattcgtgcaggtcggaacttacccgacaaggaatttcgctaccttaggaccgttatagttacggccgccgtttactggggcttcaattcaacgcttctcttgcgatgacatctcctcttaaccttccagcaccgggcaggtgtcaggctgtatacgtcatgtttccatttagcacagccatgtgtttttgttaaacagttgcctggacctattctctgcgcctcgccttacgacgaggaccctttatcccgaagttacagggtcaatttgcctagttccttaaccgtgagtcactcgagcgcctcagtattctcaacccgaccacgtgtgtccgtttacggtacgggtgccgcatggataagtttagcggattttcttgggagcatggttacgtccatattacgtcgcgcaagcgctcagtatactgtcaggttcggatctcacggcggatttgcctaccatgatcgactcctacacccttcaaccggctattccgtcagccggcaggactgtcacttctccgtctccacgtcactccatgaggcagtatgggaatattaacccattcttccatcggcgtcgccgttcggctttgccttaggtcccgactcaccctgatccgattagcgttgatcaggaaaccttggtctttcggcgggggggtttctcgccccccttatcgttactcatacctacatttgcttttccatgcgctccaacaagggtcatccctcatcttcgacgccgcatggaatgctcccctaccatgtcttacgacatccacggcttcggcagatcgtttatgcccgattattatccacgccagatcgctcgactagtgagctgttacgcactctttaaatgaatggctgcttccaagccaacatcctagctgtctctgcgatccgacctcgttagttcaactcaacgatcatttgggggccttagccggtggtctggattcttctcctctcggacacggaccttagcacccgcgccctcactccctttaaatatatatcgcgcattcggagtttatctggacttgataggcggtgaagccctcgcatccaatcagtcgctctacctcacgatatactataaagaggctgcacctaaatgcatttcggggagtacgagctatctccgagtttgattagcctttcacccctaccctcagctcattggaaagcttttcaacgcttacccatccggtcctccagttggtgttacccaaccttcaacctggccaagggtagatcactcggtttcgcgtctaccccccccgactggccgccctcttcagactcgctttcgcttcggctccgtaccttaggtacttaaccttgccggggaaggtaactcgtaggttcattatgcaaaaggcacgccgtcacatattgctatgctccgaccgcttgtaggcagacgggttcagggtctatttcactcccctgctcggggttcttttcacctttccctcacggtactggttcgctatcggtctctcgggagtatttagccttacgggatgggccccgcccaacgaccccgagattacaaatcacgtgctctggccaactgagctaaagaggcaggtgggtaagcttactacatcgcgccgctacaaccaagtacccttgctgcggtcaagccctgggggattccgagggagcatgccgtgtaggacttacccgggtgcaaaagtagatattattttttactttgcaagcgttttcttactcttgggatgataattgtttataaagaattgaaaaccttatgcttttggtagtgttaaagaatgttttatgtgttgtggccgatggtttatcaaagaatgttgattttttcattgtgaggaaaaaacattttcatcatgaagaaaaagtattttcaccgtgaagaaaaagtattttcatcacgatgaaaaaacagtttacttggaagaggttccgctttccaatatgctgacgatggagaacaacgtaaagcagatcgctcccagtccggccaatacccgtgcgggaatggcataataactatgctcggccgccatctcgaaaaggaaagcggagaggaaaaggcagaataaagccgtgaatataggaattaatggaatccggttggcaagcttgaattcttccctccatattttagacagcaagatcaccttgctggagatactatagcaaactaatccaaggccgatcatgatatatccggttgaggcattagccgggtcgctatctcctaatacgaagagaccccatatcagactgatagatcccatcaggatgacaaaacggtgccatagccttttttccaatcgggaatatgtgtttcttatttgtcgggcgatcgtggcgactaaagcgattaagctgctgcaaatacatgctagtccggccatcacgtgcccggcgacaaagtattgggaatgctcgtcgctatgcgctagcaaccggtaagcccaaatccatgcgactatggatataaatgatgctacaaggatcaagaatatcccttgccaaaagttgaacgctttgtctggtattctgggatcgtcgcttttggcgttcatttgtattaaggtgaatcgggtagaggcggtagccgttgtcgctacgcatgcggttataaggcccaccccgcaaatgacatggcccgcgacaaagtctgctggcgccggtgaggacatgagtaagataaagcccgccagaaaagtgatggttgccgagagatatccaaggataggcaaggcgaatctggccacattattatatgtatggataatttgacgaataatggtcgctgccgtagcgaacaaggctatacaaataaagccaagagagaatacgacaggtccggcgacgaatctgctggagtccactccatagttaaagacaaaaaatccataaccgaaacaaaagagggccattagcaatggaatcgccctgaataagacactaatcccgtaattcataacttgttttttatttagatttttcttcaaacagagatgcgatcctttttgttcaagaagaattttagaggttatacgatgtttttgcgtgttatttcatcatttttgtttttctttgcggaaaatatcagagaagtgaatcttattatagaacaaggtaacacgtcatcaaaggtcgctgtgtataaaaatgggcatatagaggcttcttttgtatacaagcaattcggtgtatctgtggtcgctgctctttttgagaagtacgcttttacgcaaggcattttatcgacggtgatagatacggacgatgagttgatcgcttatctaaaaaataagcttcagcgttttgtctttctggatgaacatgtagctttaccgatcaaggtggaatatgggacgccgaaaacgctaggcaaggaccgtttggccgctgtcgtgggggcaaattatttgcggccgggaaaaaatctgctggttatcgatgccggtaccgctatcacgtatgaggtgatagaagcgccgggtatctttctgggggggaatatctctccggggatgacaacccgttttcgagcgttgaaccattttacgaagaagctgcctttggtaacggaagaggatgatataccgcttatcgggagaagtacggaaacggctatccaagcgggtgtggtgaatgggattgtttacgagatggacggatatattgacgagctgaaagtaaaatatccggatcttttggtttttttaacaggcggtcattcgttttattttgaaagacggctaaaaaactccatctttgcagacattaatttagtgttgacaggattaaacagaatcttagagtataatgttgaaaattaataaggtagtaataataagttttcttatctttacacaattgccattgtgggctcaaaataacacgaactcgccttatacgcgatttggatatggagagttggcggatcgatcttttggtgccggaagggcgatgggtggagtcggttatggattaaggtcctctaaacagataaatccattaaatccagcatcttatagttgcatggattcgttgacattcctttttgattttggtgcgtccggtcaggtgtcttggttctatgacggtacgaacaagcaacgacagatgaatggaaacgtggagtatatcgccatgcaatttccgatcacccggcgtttagcgatgagtattggtttattaccttattcatatgtaggatatgatttcggcgagagccgtaccgagggcggtttaagttggggagaaagctttagtggcgaaggtggcttaagcgatgcctatttagggctctcctatgatatttggaagaagcgtctttccattggtgtgaacgccggatttttatttggaaatataacacattcccgcaacttgattttcccgagctcgacaggggcggacgatgtgtatagaaaccaacgttatgagattcgtgatttaaagttagattttggtattcaatatacgcatcctttgagtaagacggagcatgtcacggtaggtttcgtttactctcccggaaaaaagttgaatacgactgtgtatgatactcagcttgtcggttcttcggctacatccggatatacaaggaacgatacaattaagaattatcggtttgatatgccgaactcttacggagcgggtatctcctatgtgaaagagaatcggttgacattagccgcagacttcttatatgaggactgggcgaacgcttattttgataacgagaaaggtcaattcaagaatcgtacacgtgtagcggctggtgccgaatttattcctcgttatgataatcgtaattatctgggacgtatcagataccgtgccggttttcattatagcaattcgtacttaagagtcagtcgctccgaggagaatggttataaaggacatggttataatgaatatggggcgagtgtcggttttgggcttccattgatcgataaccgttcattagtgaacctgtcatttgaatacgtgaagatccgtccggaattacgtacaatgattgatgagcagtatttccggtttacggtgaactatacatttaacgaattatggttttttaaacgaaaagtggattaaaccgggaatggccgaaagggtctaatgagtatgatacttttttgaaggaatataaatattatagctaactttaatagaaagagatatgaagatcaaagttttattactagcgcttggatgtactatgggtacgttaggcgcttatgcgcagaaaggagtagataatggtacacagttcggttccggtgaggatagcgtgcgttgtattaccaatatcagcttgttcgttccttacgcgaaagccggaaacttcaaagacgcctttgatttctggaagatcgtgtacgatgagtgtcctgccgctacaaaagatatctatttgtacggtgtgaaaattatgggctggaagatcgcccaagagaaagatcccgctaagaagaaagctcttattgatgatttgatgggagtttacgacaagcgtgtgaaatattttggaaatgatcgccggtatggaaaagactggatcgttgctcgaaaagtgcaagattatttagcgcaaactggcgataatgccgactataatcaggcctatacttggttgaaggagatcgttgatgagaaaggtgctgatacggaggctctaggtctctccttgtttagtttctcttctatgaagaaaatggttaacgatccgaatttcaaagaacagtatattcaagattatttgaaggtttctggtggcttggatgctcagttaaaagctgcgcaggctgcaaacaatcaaaaagaagtgaatgccttgaccgcatataagagtggtgttgataatgcctttgcgaatagtggtgctgccgattgcgagactttgcagaatttgtatgctgctaagatcgaggagaataaggacaacttaccttatttgaaagagactatatccttgttgagaagaacaggttgccaagaaatcgaggcttactttttggcatcagactatgcttatcgtcaagaacctagtgccgaggctgctgttgggctaggaaagaaagccgttaagataaaggattatgatacggctattaaatactttgatgaggctgcgaatttagagacggacgcgacttcaaaagctgatgattattatatgatcgcattgttgctgtttgagcaaaatgcttattcaaaggctagacaatattgccagaaagctttggaggtaaatcctaactatggcaatgcttatttattgatcggcaagatgtatgccgctacttctaaatctgtcttcccgaatgatggagtattggcaagagctgcttataatgccgctatcgataaatttgagaaagcgaaacaggtagatccgagtgttgcagaagaggctaatactttgatatcatcttatcgtgctcaccttccttctacggaggagatcttcatgcacccggatttggagaagggcaaacctttcactgtcggtggttggatcggagagcgtacaacgattcggtaattatgataggaaatcgttttcattgtaaaacggaaaatatgggcataacaactaccttcgtggtggttgttatgcttcttttgttttctgcctcttgcagtaaggaacataaggaggtggttgatgttgagtttgatccggacaagacttatacgatgaaggctacggatgtgtcatccttgatctccgattctggtatcacgagatatcgcttgaaagcgaaagagtggcagatttatgggaaggcggcggaaccccattggtatttccccgaggggatctacgtggagaagttcgataccttattccagacagaagcgagtattaaggcggatacagcctattattatgataaaaaagggctttgggagctgatcggtaatgtagaggtggaaagtctgcaaggggagcattttgagacttcccaattgttctgggaccagaagcaagagaaggtttattctgataagtttatgcgtatcgagcaagaagataagatcataacaggtataggttttgagtcgaaccaagatatgactcagtataagatatttaactcacaaggtattttcccggtgagcgatgctccggccgatacgacacggacagctcagggggatagtgcccgggtagatgtgtcacaaatagattcaataaaaagtaattaaggtggggacgctgacttatattttaatttccctcgcattttccgcattcttttccgggatggagatcgcttttatctcctccaataagcttcgtttcgagctggataagaaggaacgtagtctatccagtaagatactgggtgttttctatcgtaatccaaatttgtttatctctaccatgttggtaggaaataatattgcgttggtcgtttatggtcttcagatggcaatcgtattggagccgtttatagccaaggtggttgcgaatgaggcattgatcgtttttatccaatccgtgatatctacgatcttgatcttgtttgccggggagtttattcccaagaccatatttaagttgaatcctaatttatcactcaatatatttgcgataccattatttatcatatatatcatcctgtatccggtctccaagttctcatccttgctatcttttttgattttgaagttagggggcgtgaagaacttgaaaagttcacctcaggcattaggcaaggtagacttggattattttatacagcaaagtctggaagatgctccgcaaaattcggatatggatacggaagttaagattttccaaaacgccttagacttctcgaatgtccgtttgagggattgtatcgtgccccggacggagattgtagcctgtgatacgtcggctacgatagaggaattgcgttctaagtttatcgagacaggactttcgaagatattggtgtataacgagaatattgacgatattatcgggtatatccattcttccgagcttttcaagaatccggaggattggacccagcatatccgtagcgtatcgatcgttccggagacgatggcggcgaataaactgatgaaactgctgatgcaagagaagaagagcttggctgttgtcgtggatgagtttggcggtacgtcgggtatcgtgacacttgaggatttggtggaggagattttcggagagattgaggacgagcacgatatgaagtcgcatgtggctaaaaaagtatcggacaatgagtatttgctgtcgggtagaatggagattgataccttgaacgaaatgttcgggttggatcttccggagtcggatgattatgtcaccatcgccggttttatcttgcacttctatcaaaaattcccgaaattgaacgagactgtccagatcgataaatattcgtttaagataatcaaagtaacggctacgaagatcgaacttgtacgtatgaaagtagggatttgataaaaaaaaggattatatgctgtggaatttcctttttttcatatctttgtgcccttaaaatgtgaaataataaactttaaaaaataataaagataaatggctacgctggaaaaaattagaagcaaagcaggactgctggtactcgtggtgggtttggcattgttcgcttttatcattggagactttttaaactctggttctacttattttaggcaatcacaggaacggatcgccgagattgatggagaggttgtaaaaattcaagattatcaaggtcgcgttgatgagatggccgagatgtataagatgcaatccggttcagccagcctgcccgaggaatatatgacacagattcgccagtccgtattcgatgcgatggtacaagaggttgtgttggacgaggctactgctaaattaggtatgggagtaagtccggaagaattgttcgatatggttcaaggtgagaatatctctccgttgatccaacaaatgcaaatgtttacgaatcctcagactggtgcttttgataaggccgctttgttgaatttcttgaaacaaatcgattccgataatatcgctagctatccggcagatcaacaggcacagctgattcaagctaagaacttctggttgttctgggagaagaacatcaaacgtcaacgtttggagcaaaaatatacgacattattgagcaaggctatttccgcgaattcattggacgctaaggaagcttataatgataatgccgagaattcggatatcatttacgctatgcaatcatatgctacgattccggattcaacgattgaggtaagcaagagcgagatcgagaaattgtataaccaacgcaaggagctttataaacaaaaagaatctaaggtaattaaatatatcgccgtagatatccgtccgagtaaagaggattatgataaggcacaggccgagatcgagagcttgaaagaggagctggctacgtctgaaagagtggctgatgtagtaaacgagaactctgaggttccttatgttgacgctttcttcacggagaaggctttggatccggagatgaaacaattcgctacgacttctgaggttggcgctgtttatggtcctgtattcgagaatgacaaatacagaatgtttaagctagtcgataagacggttgctccggactcagtaaaagttagccacatcatgttggccggtaaatctgaggctgagacaactgctttggctgatagcttgatgggggcgttgaaaggtggcgctaatttcgctgaattagctaagaaatactcagcagaccaagccgccgagaatggtggtgaactaggttggtttacagaggttaccgctttgagaggtgtgaatgatgattttaagaaggctgtcttctcaactccattgaatgaggtagcggttgtgaaatctttatatggtactcaccttgtaaaagtaacagagaaaacaggaaatgttgaaaaatataagattgcagatatcgacatgactgtatctcctagctctaagacctatagcaacatctacaatgagttgaatcagttcgtatcgaagaacaactctatggctaaattggaggagaatgcgaaggaagccggttataacttgatttcaggtgcaacggttactacggatgatcagttgttaggttctatcaagaattcacgtccggtaattcgttgggcgttccagaacgataaaggttctatctctgagatcttcgagtgtagtgataaatttgtcgtggctgctgtagaaggaagtatttccgaggggtatcgtccggttgatatggtcgctccggctttgagagctgaattggctgcccagaaaaaaggcgataagatcgctcaggaattggctgctaagaatttaacttcagttgaggcatatgctgaaacgatgggttcttctgtagactctgtaaagttcgtgaactttggtactcgccgtatcgctggtatcggtatcgaaccgaacttgaacgctatggtttctatggctcaagttgaccaagtaagtgctccggttaaaggtaacaacggtgtatatgtgttcaaggtatacgcaagaaataaagatggtaaggagttcaacgaggctgaggaaatccgtgcgttggatgcttcgaacgcatatcgtgtaggattccaagctatccaatctatggtcaacaacgctaaggtggaagacaaccgtatccgtttctattaataaagagtatttatacttaagataaaaaagatcccctgttttgtcgtcaagatatatttattttgacggcaaaataggggatctttattttgtggaatatttctcgtactttcgcgaataagaaaatatcgatagcatggttgacaaaagacaattattagggatgaccttggaggaactgaaaggtgtagcgtctgaggtgggtcttcccgcatatgcggctaagcaaatggccgattggatttataagaagaaaataacccggatttcggagatgacaaatatagcggtagccaaacgtgctttattggaggattcattcgagatcggggcttatccaccatctgagtatcaaaagtcgaaagacggtacgatcaaatatctatatgctgccggaccggggcgttttgttgagtctgtttatattcctacggatgatcgggcgactctttgcgtctcttctcaagtcggatgcaaaatgaattgcttgttttgtatgacgggaaaacaaggtttcacggcaaacctgacagcgaaccagatattgaaccagatccagtccttgccggaaaacgattcattgacgaatatcgttttcatgggaatgggggagccactggataacgtagacgagcttttcaaggttttggaaatactcacggccccgtatggatatgcgtggagcccgaagcgtatcacggtttcaaccatcggtgtgacgaaaggcttgaaacgctttttagaggagagcgaatgtcatctggccgtaagtctgcactcgccctatcctatggaacgtctttccttgatgccggttgaaaaggcattcccagcgagggaggtgatcgatttaatcaaacaatatgatttttcgcatcaacgacgtgtctcttttgagtacattgtttttaaaaatttgaacgatagcttgaaacatgccgaagctttgagttgtttattaggtggaattccttgtcgggtaaacttgatccgttttcatgcgataccgaatgtgtctttagagacttccgatatcgttaaaatggaggcgtttcgggatttcttaaacgccaaaggagttgtatgtacgataagggcatcacgtggggaggatattttcgccgcttgtggaatgctttctaccgcgaaaaatgttacatttgtataatataaaacacacaggtatgaaaacacgttctttattcatcggtatgttgctgcttcttgttttgatgggagcatgtaattcaggttctgtgatgactcaagctacgggcttcgcatatgaggttgtcgtggttatggatcaaaaggattggaaaggccctgcgggagaagccataaagtctgagttggcctcttcggtgcccggacttccgcaagccgagccttctttgaagattacctacgtacaaccaaaggattttacaggtctgttacggtatgtaaggaatatattagtggttacgatagaccccaccgcttatacgaaagtttctgtaggctacgagaataatgtctgggctagagggcaggtggttgtttcgctgaaagctcctaatacggagtcgatcgtcgagtattcaaagacccatgagaaggcgttggtcgatttcttcgtaaaggtggagatgaatcgtgcgatagagcaattacaaaaggaatatagtatggtggttatggataacctgaaaagcgacctgaacgtgatgttaaacgctccggcaaacttcacgtactataaggatacgacagatttcttctggtcttccaataacgctaacacaggccgtatggacttaatcgtatatactttcccttatactgatccgaatacgtttacggaggaatatctggtcgctaaacgagattctgtattgaaggcgaatctgccgggttcgttcccgggttcctatatgcaaacagaaacgcgtgcgggagtggagtatacgccaataaccttaaatggtaaatattgcggcgtgatgcgcggtttgtggagaatgcaaggcgatatgatgggaggcccgttcgtaagccacacccgcttggatgaaaagaatcatcgtgtggttgtagccgagggatttgtgtatgctccggagacagacaagcgtaatttcatgcgtagaatagaagctgccttatttacgttacgtttgccgggtgaatttgatgaaccggtaactgagacattagatatcccaaaagagaaaaagtaataaacaaacaaaatatatggaagaacgactgattaaagtggggatcacccacggagatataaatggtatcggctatgaggtaatattaaagaccttttccgatacccgcatggcggagctttgcacgccgattatctatggctcgtccaagatagccgcttatcaccggaaggcattggagcttcctcctatcaatatgaatattatttcacatgcggaggatgcgggagtaaaccgggtgaacattattaactgcgtggaggacgagaccaaggtggagttgtcgaaatctacgccggttgccggtgagtcggctttcaaggcgttggaagcggcagttacggatatgaagcggggagtagtggatgtactgcttaccgccccgatcaataaacataatatccagaacgaggattttcattttcccgggcatactgagtatttggagaaatgcttcggtggcttggataaaaaagccttgatgatcttgatgaaagatgatcttcgtgtcgctttggtgacggggcatattccattgtcgcaagttgcgtcttccatcaacgtgggcgatatcgtgaataagctgcgtattttcaatcagtcgttaaagcaagacttcggtattgtgaagccacgtatcgcggttctttccttaaaccctcatgccggtgatgccggattgctgggtacggaagaggagacgattatcataccggcaatgcaagaggcggagaaaaaaggcgtaatgtcatttggcccttatgcggctgacggtttctttggttcgcagatgtatgataaatttgatggtgtcttagcgatgtatcatgatcaagggctcgctcctttcaagacgttggcgatggatgacggggtgaactatacggcaggattgccgatcgtacggacttctccggcacacggaacagcttatgacatagccgggcagaacgtggcttcggaagagtcgttccgccaagccttatatgcggcgttggatatcttccggaaccggttgcgttatcaagaggctaccgccaatccgttgcgtaagcaatatttcgatagggggggggataatgagaaactggacttgacgaaagaggacgatacggacggattatagtagatctttcctgacaagtttcaataaatacataaaatgtcatgttaataacgaatggatgttattgacatgacatttttgtatggggcgtgggacgctttttggttttaaacttttaagataggaaaagtttgcgtaagtttgcggtttaaaacgaaaattacgattatgtttaaagacaaaacgatagtatatacatccgggacgtttgatatgttccattataatcatcttcgaatgatcaattacgcccgtagtttggcggatatattgatcgtcggggttagtacagatgagttggtctcttcttataaagcgaagccgatcattccgttccatgaacgtttgcagatcatcgaggcgttgaagactcccgatatcgttattccacaacattccttagatcatacggaaatcgtgaagaagctgaatatcgacgctttcgtggtaggtgatgactggttcggaaagtacgactatctgaaggatttaggcgttcaggtattttatttcccttacggaacgggggtttcctcctcgaatctgaaaaaaacgatacatgattcttatgaggcgaatctgacaacccaacgtcaggcgaagccggaaacagtgaaaggatctgccgctaaataacgatcagtttcatggataaatttattttaattaccggtgggacaaaagggataggaaaggcggtagcgtcctgtttaggaaaggccggatataaccttatactgacttatgcttccgaccaagcggcggccgaggaggtacgtagcgagttggtggggcgtttcgatatacaggtttctattctgcgggccgatatctcggatcggaatacgatcggggttatcgattctttcttggaggagaataggctacgtttggacggccttgtgttcaatgcgggaatgacctgtcgggatccttttgaggaactttcattcgaggattgggaacgggttttctttgctaatatccatttcccggtcttccttttacagaagattgttggacggattaataaggggggaagtatcgtgtttacgggttccttgatgggaatacagcctcattcggtatccttggcatatggggtgacgaaaagcgcggtgcatgcgctggtcaaaaacatggtgaagttcttagttccctatgaactgcgtgtgaatgccgtggctcccggttttgtcgatacggaatggcagaaaacaaagcctgccgagatccgtcggaatatagagaacaaggtctctttgggacggttctgcgacccggatgaattggcggaagtttataaaatgttgatagagaatagttattttaatggcgaggtagtcgttgtggatggcggttactcgtataaataagaaacaaatgagcgagttggataaggaatacgaagcatcgttaaagtcgatagaaacagaaaataagatagaccgaattttttatcgtccgataggatttcgtattgctcgtatgttgcgaggcacggggattaccccgaatatgattacggttatctcgatcttcgtgggtgcggcggtcggatttatgttttatcacgataatttgacatataatatctgcggtatattattgttggtatttgccaatatcctcgactgcgtggatgggcagctggcacgtcttacagggatcaagtccgctatcgggcgtatcttggacggattcgccggggatatctggttcgcttcgatctatatcggattcgctcttcgtctgtctcatgattacggtacggattggttctttgccttggcggtcttatccggtctgtctcatttagtccaagcgaatatcacggattattataagacgcttcacctttattttatcagtaaggataaaggctcggagtttcagtctttggagcaggtggaggcgaaacataaggagatgaagtatggcattaacaagtttttctacttcttatatcgttggtatacgatgttgcaagtgaaagctacgcctaccttacagagtatgttacaaaatttgcacgcgaagtatggggataatattccggagaatatccgtgtggactttcgtaaacagagtcgtcatttaatgcgttacatagacttgttgacctttaatggccggacgatggttatgtttgtgatcgtactaacgggacaggtctgggcttattacctatacgagatcatcgtgttgaacatcgtactagcgatagtgatgaggaaacacgagaagatgtgtgcctcgtttttaggataaagtatgaagaagagtgttgttgacatttacgatttgcaagagatggccccgttctttaaggggcgagtggggacatggttaggtaagttgctgataaagtgtttacgtgtggatctggttaataaggtacatgcccggaattgtcatttacggggcgctgagtttacttccgctttattgcatgaccccattatcgatctcagctatgaggttcataataaagagattttagatcatctgccggaaggggcttttgttaccgtttccaaccatccgatcgggtcgttggatggaatcatgctgattgatattttcgcttcccgccgtccggactttaaggtgatggtgaacggcatcttgaccaagatcggggcgatggaggataatttcatatccgtggtgcccgattcccacaagcgaggggcgaatccggcgaatgttaatggcgtgcgactatccctgcaacgcctgaaagaaggtcatccgatgggtttcttccctgctggagcgatctcattttataataaaaaagagaaacaggtacgggatttatcgtgggcgcatagcgtgatccgcttagttcgtaaggcgaaagcaccggtataccctgtttattttgatttccaaaatacccattttttctattggctagggaatatcagctggcaaatacgtaccttgcgtattcctactgaggctttcaataagcgtggaaagaaagcggatgtatatatcggtgagcctatctcgccggaagagatcgccgccatcccggaagacaaggatcttgccgagttcttgtataaacgtacatatggtgctaaaaaataagaaacgaccgatagaatctgttatcaatagtggtagtttgaattaagatttgtaattttggcagagtaactgaaataattacagattttaaaagtgaaagagtgatgaaggttgatgtacaacagataaaacagcgttttgggattattggtaataaccccggattaaatcgtgcgatcgatgttgcgctccaggtagcgccaaccgacttatctgttcttattacaggagagagtggagtaggaaaggagactttcccgcaaattattcaccagaacagtcagcgtaagcatggacaatatatagccgtaaactgtggcgccattccggaagggacgatagactcggagcttttcgggcacgagaaaggttcttttaccggggcgttggccgaccgtaaagggtatttcgaggtagcggacggtggaacgatcttcttggatgaggtaggagagctgccaactcctacgcaagcacgcttgcttcgtgtgttggagacgggtgagtttatcaaggtcggttcctccaaggtacagaagacgaacgttcgtatcgttgccgctacgaacgtgaatttagtgcaggcggtttcggaaggtaaattccgggaggatttgtactatcgtttgaatacggtgcctattcaagtgcctcccttgcgggagcgtccggaagatatcgtcttattatttcgtaagttcgccagtgattgcgccgagaaataccggatgccgccgatccgcttggatgatgaggcccgtcaattattggtttcttaccgttggccgggtaacgtgcgtgagttgaaaaatatcacggaacgtatctccgtaatcgaggagacacgggatataacggcggatgtcctgcgcctttatctgccgaacgtgaatgttgagaaatatccggtattggtgaagcaagatccggatcaaaagatatttaacagcgagcgggagatcctttatcaagtcttgttcgatatgaaaaaggacgtgaacgagctaaagaaattagtgcatgatatcatgggagggaatatcccgatgccaacggtggcagacgataccccttatgcgcatccgatccatccggcggcggttcatgccatgcacccgacgatccaagatgccgaggatgtggaagaggagactttatccttggaagaggtggagaaggagatgatccgtaaggctctggagaagcataacgggcgacggaagaacgcggcagccgacttgaagatatcggagcgtacgttatatcgaaaaatcaaggaatacaatttggaataaaaatatgctaaagaagattgtcaacatacgtttgtcggcagccaattggcttatactctcatttttgacggtattggctacggcttgctctatttcctataagtttaatggagcctctatcgattatacgaaggtgaagaccattacgattcgtgacttcacgaaccaagctccctacgtcaatccgacccttgcgccgcagtttacggaggatttgaaggatatttacatccgtcagactcgtctgcaactggttccgagcaatggcgaccttgagttggagggtgagatcactggttacgatttcgctccaatggccgtgaaggaggatgctatcgcctcgcagacgaggttgacgatcacggtgcgggttcgttactccaaccgggttaacccggatgaggattttgagcagtcgttctccgcttaccgcgagttcgacagtaacttgatgccgcagcaggtagagggaacattatgcgaggaaatcatagaggaaatagtagaccaaatctataacgctacggttgccaattggtagaatgagggcggaggatttatatcgtttgatggaggagccttcggaattgaccgaggggactcttcttgagttgcgacgaatcgtggaggattacccgtattttcaagtggcacggatgttgtatctaaagaatctggccgtattaaatgatatgagttttacctcggagctggagaagatgacgatattcttgccggaccggaaaaagctgttccaactgatagagggaaataaatatggcttgaactcccgtgtggagcatgagccggatatgcgaaaagaggatactttctccttgatagacgcattcctctctaaccgtaacgaggaaccggagcctaagaaagaagccccgttcctgttccagccatcggtatcgtcagattatatgttttggtcattatcgaaagaggaagaagagaagccatctggagaggatgcggagaataggcttcgacatcacgacttgatcgattcgttcattaaaaatgaccaacagcgtatgccgggtagtgggctggaaatccgtgaggaaaccagccgtgcggagactccagagtcggtgaaagatttggatgatgagcagtccaaatcgctggaagactcgtgccttacggaaactttagcccggatttatataaaacagaagcgatatgataaggctttgcaaattattaaaaacttaagcttgaaatatccagaaaaaaatgtttactttgcagaccaaatcagatttttggaaaagttgattattaacactaaaaaataaaactaagatgtacgtatttatttctatcttaatcctgattgcctctatactattaatcttgatcgtgttgatccagaactcgaaaggtggaggtttggcttcaggattctcttcttctaaccaaatcatgggtgtacgtaagaccacagactttttggagaaagctacttggagtttggcgggtgccgtaatcgtactgagtatcgtgattaccgcatttatccccagaactgagcatgccgctcaatcagagatcaagcaacaagtgaacgacgctgtctctatcgatcctaatacgatcgctccggactttggtacagcgcaacaaccggcagttccggcagaggaaactcccgctactactacacctgcggaggaaagcaacaaataagattgtatttgagaataatatagaagccatatccactaacaatggatgtggctttttttgtgctactttaagtggaagcttctttatctcttaatcttttcacctatgtgaaaagatcgtatcacaagggtgaaaagatcgtattacgtatatgaaaagatcgtttcatctttgtgagacgattattgcgaataggggcttctatctcttcatagaaagaaatgatcagttaagtggaatattgttcgtatatttgttacatataatagtaataagtataaatactcagatatggatatgataaattttgatgggttgttgatcggtatcgttacatttttgattatcggtctgtttcatccggtagtcgtgaaggccgagtattattgggggacgaaatgctggtggatattccttgtcttggggattttaggagtgatagcctccctgtttatagacagcgtgtttgtgtccgctatttgcggcgtattcgccttctcatcgttctggacgatcaaggagattttcgaacaggaggagcgtgtgcagaaaggttggttccctagaaatccgaaaagaaaatacccttgggacgatagtgaggtgaaatgaattcttttcgtatctttgcgctcgtgaaagcgatataaaagcaataaagctatgaagagaaagagaaaaaagcaagatccgttagtcgagtacataaaggctaaccggaaaggcagtcgtgaggccgagttagaaaaccacggcaggccggtcagtcataaccggattcatgtatcgaagaaagtttataatcgtaaaagaatgaaggcagatgcccagaggcatctgccttatttgtttttagtggcctaaaaggagaccttagttcgctgtattgttattgatcggtgtcttttccttgaaccactccactagtatcccattcttgaagcttaggatgtagtagccttcagagtagtcggctatcgtcatggttaccgtcttataactgatactctctatcggaccgtcgggggttatccgtgcgccagccgactcaaaatcctttcctagtatcgatataaccttttgcttggtcatccctagctctatcttatgcattcggttgtccattttataaggattcattaccgtagcgcatcccatcaataggaacattgtcagcaacacgtatatccctttcaccatcttcatctctctttttgttatttgttgtattgggggctaaagtagacattatcccggatatatagtaatacgaggatataaaaaaagaggaaaacctttcgattttcctcttttcctagagcggaagacggggctcaaacccgcgaccctcagcttggaaggctaatgctctgataggcacgtacaaaatggtctgaacttgccttactcgctgaatagggcgaatgaggattgtatttcgttgtttcatagaagaaatcatctccgtatgccaagtgatgctcaccggaggaagccgctgtcatgaacgggggctcgattccttccggatggttcatcgtcaacgctccatacacctcatcggtagagatatgatagaagcgtttaccctcatacttctccggcaggctttcccaatacaacttagcggcttggagcaaagccaaagtacccatcacattggtccgggcgaatgtaaacggatccttgatacttcggtctacatggctctcggccgccaaatggatgataccatcgatctgctcatcccgcatcaattgatagaacgcctcaaagtcgcaaatgtccatcctcacaaacttatagtttggtttgtcctccacatcctttaggtttgccaagttgccggcgtaggtcagcttgtccaaattaatgatgttatatcccggatatttgtttacaaacagacgtacaacgtgagagccgatgaagcccgcaccaccggtgattactatatttcgttttgccatgattcttaacagttgttttttaaattagtgatacatcgttttaaggattccgtccaataaggaactcgaacgccgaatgtttctttgatttttgttttgtccaataccaaataggacggacgttttacggggctggggaactcgtcgctatgacaaggccggatatcacaagcggtcgtgccattgtattcggcgatcatcttcgtgaagtcgaaccaagagcagaccccctcgttggagtaatgatagatgccgctcttgccataaatagcgcaagctatgtccgtcgcataatcacgcaagactgccgctatggctttcgccaaatcgtaagcgtatgtcggtgtaccagcctgatcgaataccaccttcagttggggccgagtagccgtaaggtgcatcatcgttttgcaaaagtttttcccgaactcactgtacaaccaagcggtacgaattatcacatgcttgcaacctacagtcatgatcttctgctcaccccgcaattttgtcataccatacacaccggttggcgtaccctgttgatcctcttggcagggcacattgtaaggctctttgccaaacacataatccgtagagatctgcaccaacaaaccattgaccgccttcatcgccttggccaaattttccggggcctcggcattcagcctctcggccaacgcctcattactctccgccgcatctacgttggtataggcggcgcaattcacgataacgtcgatgcgccgctccgcaaccagtaccctcaccgcttccaaatccgtaatatccaaaaagacagtctctactccttccacttgattcacatccgtgaatacatagtggtcatcactttcccgggtgatgatacgtatctcgtttcccaactgcccgttggctcctgtcaccaatatattcatcttattcaaattcaaggtataaatttacatgataatcaaacggtgagtcaaaatcctccaagcatggatgctttatatccttctccgagagaagggccttatccattggtatccgccaatctatgcccagactctcatcctttatacggatgcccccatccgcttgcggagcatagaaattatcgctatcaataggataggttatcctttacgaaacaaccgattccttcaacaaacctcctgttccgacactaaaaaaacgcaagatttagacgatcgtttagactagtcgtttactaatgacgattagccatcgagaagaagataagtacttaattaacactattattaatattaaattttaaattatgaacaagaagtttacaacgcttttggctagtgccatgcttgcgactgctttctcagcaggggcagcggtagacgctaaaaaaggggatgcgatcttgttgaagtctggcactgataatttgtcagctttaacgggaactaactttgggaaattgggcctaaccagtgctcctgccaatcttaatgattgggagttaaagggcttgaatggtgctacttggactgtttctgcaaagaagaatactctaggtagagatatttattcttttgagaataaagccacaggtttaacgcttgctgttgatcctaccatagctattgacgcagataaggctggtgtcggtgcgaaagctttgactttgggcggtaccgcatcagagtgggtggctgaaggtgataagttggtttcttatttcacgggagactctgttgtttatattgcaaagaacggaggtgatctttatttggaaaaaacaacaaaagctaaattaggctcatctaaagctattgatctgtcctctgctaagaatttccctaaatcaatgattttggatgcggctgacctgaacacgttattacaatctgttcctactgcgactttcttcggtttgaatatgaaccctagtgtttctactggcaaagcaaatcggttgacagacactcctcttaaggctacggacgtaagtggtgctggtaattgggtaactttacaagccaaagataaaaaagtgaaggttgatggtgaggatcaagatgcctatgtagtcgttgataccgcttattatgatggtactgagactagtaagttcttgcaacttaattacgatgctttcaaagcggacaatcgtgaagaaggttcttattactttaagtttacttataacgcagctgaagatgaattatatattcaagttcagaaggtagcttataagcttacgaaaaatgcaggtgagactgacgcggactttgctaagtatatcaaagagaataacaacaattcttactggagcattcaagatgaagaaaaccctcgtacgttagcgaccaaaactgataagtttatctatatggctagattggctggaacgaatgtcttgactatcaatacggatgagacagatctaactggtacttctgcaccggtagctatggctgatgttcagaaaacagttgttaagcttggtacgaacttctctggattgacacttactactattcctgatggtgtatatttagtacagtacaaagcatcggtaggtaatccgaagataaaacaaaatggcctatatgctttggcaaacttagcaggaagcttgggttgggctaatttggctcgtaaccaagagttcaagcatatgcctgccgctcaatgggtagtggataagaatggcacttcttctactgctatggttacgattgataatcgtgagttcagtgatgtttctaatacaagtgttcttccgtctcaaatgactcaattctatgcggtggaaggtagtgatgatgtgttctacttcaatggtagtgtagctgatactttgagttttatcaaagttgatgatgcattggttaaggatacaaaattaggttataagtatgtaacggctgaagaagcttctgttcagacctatttgttcaactatttgcatgggctggcattggataagtatctgtatactccggcaggaaaagactctattgttcgtgtagacgagaatggagaaaaagcgaacttccgtttgactttgatcgcaaaggatgacaaatatggttataaggatggtttggtaagaaatgcgtattatgtttctgatggaaaaggccgttatatttcatttgacggtgtagcgaataagtatatgatgaaatcagtaccgactcctttcttcttgaaagagaacaattgtattgatggcactcattattatactttggtagaagctaatttatggtttactcaactgcagaaaaatggtgacagtgatatagcgctatcttggtatccggcttctgaagtaggtaaaaaggtagctgatgctaagacttttgctgatctgaatcccaatacagtaactcgtacttatgaaggcgaggagggtgatgtcacggtgacttattatgccgatgcaaattataatattgcgacagctccatattatgataagaatggtaatcgcttgattacggatgcgagtgaacttggagatgtatatgcttatatggcaaaggatggtgtagtagcattgcaaaaagcatttacttcatcttcttcatacagaagctacgcatacgcatctgtaaaagtatctgtagatgataatacgttagatttaacagaaggcactctagatgataagttctattctgagatccgtacctctgcgttcgctgtatcaaaagacgattctccattataccgtcgtttcaacaacgttgcgttgggcgagagcgaaaccgctgacagcttgttcttcgttgaaaagatccgtaaggaatatttgatggatgaatggaacaagaacttaacagacaagaatgtagattacgctggtatctggaataaggagaaagctgacggtaaattaggattcatcgttgataccgcttgggttaaccgtggtaatggcgatatcaagccgcaatatttgatctctgtcgctcgcaatgatcaagccggtactccgggtgttccttgtacgtatgagcataatcactttgataacgctggtaatcctgttgacgcagcgcattgctctcatgcaactcaaggccattcaggcttcgactacggtaagtatttggtaagctttggcgactctgcccttattaagggtcatgaattgaaggttccgtatatggatatcgatggtggttatactcgcgtaggttttgttaaggcaatccacgctggtgacagcttgttcgtcttgacacaaggttttgagaacatggatccggctacattggatacagctacgatcatcaatgcttataagaagagcaagagcgagaactttatcgtgaacttacagggtgacaaccacaagaacgtaacttggtcattccgctatgtaaacccggataaggctggtgctgtaacggaagagggtgctgataacgaattcttgttcgagtcgaacatctataacgaggcaggcgttgcttctactggtaaggctactaagggcttcgataagaccgttgccggttcaatcgctccttcttacgccgcatggttgaagatgcagaatggttgcttggtattgactcgtggtgattcagagtttagcgcagctaagactggctctgacggtgctttgatcttcaacgcataccaaaagactgacgctgaggatatggtaacatctatcgaaggcgctaacgctgaaggtgtatctatcatcgctggcaacggtactgtaactgttcaaggtgcagccggtaagtcagtagttatcacgaacatcttaggtaaggtagtcgcagagactgttcttacatctgataacgctacaatcgctgtacctgcgggtatcgtagcggtagctgttgatggcgaggaagctgttaaggctatcgtaaaataagatttataaagaaataaaataaatcgaaaatacattcccgtgcgggtaaccaagtactccgtgatggatgaacaagcgggaatggattaatattaatactaaagtaataaattaaagttcatcccggctaggtatagccgttagttattcactcgacaagccgttagttattcacttcaatagccaaaaatagtgtgcttctcaacgaccaaagcatctccttttgagagaatggaactgtaagcaaaatattgaaatgaatgacttgatcgagttttatcgaaccaaaacaacagacagacgcattcgtttgtgaactaaacttgaataaatacatttgcaaacattgtggttgctcttttttctaaatattagtgcttattgcaaggaatagactaactttgcctacaacaagtataaaagttatccagtatatgagtcaagtgaaaggaattccttacggaatatcagatttcaatcgaataaggaatggtaatttctatttcgtggataaaacgatgtaccttccgcttatcgagaagatgcctagctatcttttcctgatccgtccgagacggttcggcaagagcgtattccttagcatgatgcgtacgtattatgatatattgcgtcaggatgattttgatgcatattttggagatctctggattggtacgcatccaaccggtgaaaggaataagtatcaggtactttatttcgatttctctaaagcgggctgttcgatgccgggagcggacttgatgacaagtttcaatgattattgcagcttaatcattaatcagttcgcgcatgtgtacgctgctttttatgacgcggattttaaggagaccgtcaaaaatattgaaagtgccaagtctaaattggcttacatagaaataaaagcgaaggaaaagggatatccattgtatctcattatagatgagtacgacaactttaccaatgtgattttgagtgagcatgggcagcaaatgtttcatgacttgactcacgccagtggtttctaccgggagtatttcaagcaattcaagggaatgtttgaccgtatattcatgatgggggtaagccctgtgacgttggatgatttgtcgagtggatataatatagattggaatatctcggtagatcctcgttttaatgctatgatgggctttgacgaaacagaagttcgtgagatgtttcattattatcagcaaaacgatatgctcaatggggacgttgaggcaatgattgcggagatgaagccttggtatgacaattactgtttcgcaagaaagagcttggatgacgatcgggttttcaattgtgatatgactttatattatttacgttggcaagttgattttcatcgtgccccagaagaaatggtcgataagaatatccgaacggactatagtaagctgaagatgctggcacgtattgatcgcgactccgtacaagagggagatcgtatgagtaccatcgaaaagattgctgcggagggagatatcttcgtggatttgcatacttctttccccgctgagcgaataacggatatagataatttccgtagtctactttattattatggtttgcttacgatgtgtggtacacggggagatttgattaaaatgagtataccgaataattgtgtacgagagcaatatttcggttttcttcgtgactattaccaaaaatatagttctattgatttgcattatttgaatgtgatgttgaccgacatggcttacgatggccgttggaagcctttctttgagagcgtagctcaggcgtatcgtgaaaattcagccgtgcgtgacgcgatggaaggcgagcggaacctgcaaggttttctgaaagcctatcttgctcttgcctcctattatttggtggagccggaactggaaatgaactatgggtattgtgactttttccttttacccgataagaagcgctatccggacgtgaagcatagctatatcttggaattgaaatatgcgactcgtacggcaactgatgccgaactggaggttcaagcgttggagggacgaaaccaattactgcagtatagcgaagataagatagtacgctgtttgtcggaaggaacaactctgcatcgtttgttgttgcaattccgtgggtgggacttagtacgttgcgaggaagtataacataactccgcttttttgtataccttcgcgccatgaacaaacaagcactgcttttttatccgttgttgggggtggttcttttggtgctctttgtgggagggctggcgtatggggccgtaccgattcctttggatcacgtgatggatattttactggggaagggatctgataagatcgcatggcagaatatcgtgttgcaatctcgtttaccacaggcgataaccgcactgttggcgggggcttcactggctacgagtgggctgttgttgcaaaccttattccggaatccgttggccggaccctctatattaggtatcagtgatggggctaatctgggagtggccgctatcatgttgtattttggaggtacgctggggcagtttacggattggccgatcagcggatatatggcggtgattcttgctgcgttcgtaggggcttgcgtgatcttgggattgattatctatttctctgcgaaggtgaagaacaatgtcatgctcttgattatcggtataatgatcggctatctggcctcgtcggttatctctatactgaactattattcctcgacagatagggtacatgctttcgtgatgtggggactgggcaatttctcgggggtatccttggaacaattgcctttcttcgggacttgcgcattgatcgggttgctgttggctgtcttgctgataaagcctctgaatgccttgttgctgggagagatgtatgccgctaatctgggcatacggatcaagcgggcacgaatagccatccttttatgtacggggatattgaccgctacgactaccgctttctgcggaccgatctcttttatcggattagcggttccgcatatctcacggctgatgcttggttcttccaatcataagatattggtgccgataacgatgttgacgggctcctgtatcgccttgctttgtaatttattgatggtcgtaccgggaagcaacacgattttacccttgaatgcggtgacacctatgctgggtgcgccggttattatctatgtaatcgtaaaccggaagaatattcaatattttaattagtggttatggaaaggattccagttataaggacaagaaatctgagtattggatatgttttgaaaggtggacacctaaagttggtgcatgatgccctcgacttgaatttatatccgggcgaggtgacttgccttctcgggttgaatggtgcgggaaagtctaccttattgcgtacgctgtgcggcttccagccctctctggggggcgagatcgaattgaaaggaaagccgttggcctcttactcgcaaggtgatttttcccggatggtaggtgttgttctcacggagaaaacgaatgccggcggaataacggtttacgagttggtctctttaggaagacatccttacacgggattcttcggccagttgaggcaggacgaccggaggattatcgaagagtcgttggctgctgccgggattgcccataaagcacgcaattatgtgtcggaattaagcgatggcgaacggcagaaggccatgatcgctaaagctttggctcagcaatgcccgataatcttgctggatgaaccgaccgcctttctggatgtgacaagccggattgagaccatggttctcttgcataagttggcagtggaacaacaaaaggcgattctcttatcaacgcatgatctggatttagcgatccagctgggggattgcctgtggctgcaagagaaaaaacgtccgatggcatgtggaacgccggaggacttgattatgggagggtcgtttgagacattcttcagtaaggaaggaatagtgtttgatccgaataccggaaaattgaatacggtagcgcctactgttccgatcggggtagagggagatttcatggtttcttattgggtggggaatgccttgatccggaatggatttaaaccctccccggtgaataaggattctataaatgtttattgtgaggcaccggatcgcctgcgtatccaattacccaatggggatgtaaagattgcgacaagtatggcggagatggtctcatggattcaaatcttataagaaacgagtttgttatgacaaatgaaattacatggcggctggaaaatgagaatataggccgtttgttggtacattacgcgattcccgccgttatcgggaccatggttaatgctctttataatatcgtagatcgtatatttatcggacaaggagtgggtgcgctagctatctccggattgactttgactttcccgatactactctttatgcaggcatttggaatgttgatcggcgcgggagccgctacaagggtctccattcatctaggccgtaaggcgaatgatctggcagataacgtattaggaaacgctttcactttgacattcattatcggagccttgacgattatccccagtatgattttcttggatgatttgttaacgtggttcggaggaagcgagcagacgataccttatgcgaaagactatttatatatcgctatcccgggtaatttgctggctacattaagttttagctttaatgccgtgatgcgtgcttccggatatccgaaaaaggcgatgttcacgatgatgatcggtgccgtattgaacgtgatcctagacccgatctttatcttctggctggatatggggatacagggtgccgctatcgctacggtgatctccatggccgccggtgccgctttcgtgatgagtcattttatcagcaaggatagtatcgtacgtttccatacgaaatatttccggttgaaaggttccattatttggaatatatttacgatcggcatgtctccattttccatgcagctggcgggcagtgtggttgtggtgatcatgaaccatgcgttgaaagagaatggaggcgatttggcgattggtgccagcggtattatttccagtatcgccatgctgctggttatgttgattatcggtatcgcccaagggatgcaaccgattgtcgggtttaatcatggcgctgggcatcatgaccgggtattggctaccttgcggttgtctattatagtatcgaccttgattacaggggtaggatgtatcgtcagtttattattcccgagactgatcgttagcgtattctcgacggatgccgaattggtgtcgattacggataatggattacgtctgacgatgctggtctttttcgttgtcggttcccagattacgatcagccagttttttcaaagtatcggtgtcgcatggaaagcgatgtttctgagtctaagccggcaggttttattcctgataccggctatcctgctatttcctccgatctggggattggatggcgtttggctagcgcaacctttctccgatttcatcgcggcggtaaccgcatggggctttttatggtatcatgttaaaaacgtgaaaaataagggttaaagatgaacttatgtcgatgttaattgtatttttattgtatgtataaaagtacttttatagacaaacctttaaaaatgagttaatatgaagaagattgtattattgctcgccgttttattatttggtgcagggtcgatgatggcacagcaggacaagtcagcagagaaagctgcgaagcaggccgagaaagaagcaaagaaagcagagaaggcagcgaagaaagctgcggaggaagccgaggctaacgcattgtttgaacaagcggtgcaagctttgaagaataaggatttcgtattggaagcggatcgtatagagtttaagcgcggtagttttgtttatgttactccgaacacgaacttcgtttcggtgaagggtgagaaggctaccattcagttagcgtttaatactccggcggccggtcctaacggaataggaggtataacggttgatggaacaacttccggtgtacagatgaagactgacaaaaaaggaaacgttatgtacgagatgaatgtgcagggtgtagcggtatccgctagggttacgttccgtatggcgaaaggtacgaataaatgtactgccacggtatcgcctaactttaatagcaaccgtatatcctttacgggaaatctctatccttcaagcgagtcgaatgtgttcaagggacgttctatttaatgtagatacaaagaatcgtgaaggcggactttctttcgggaagcccgcctttctgtttataagaaggatgagattggactatttccaagcatcattttgtaccagataagcttggccgttctcatcgtttcctgcggtctggatctctgtctcgggaagcgggaacatcgtcttagaagcggttggagcggatacaccatagaatttagttaggtattgcttctcataatttatatatgccgtcaattccttgttcatataatcacctccccaacgaaccagatcgaaaaatcgttgtccttccatcgcaagttccagcttacgttccatatgaatcgccttgatacaagtttccttgttgctgaatgcggcgtgactggatggataaggtttcactaaataattggcggcaggcgttccgtcttccagataaatgatattatccggtttggctgcacgttcacggatatcgtttacttgctgcatggcggcacttaattctccgtcgttcgctaggcattccgcgtataacaatttacaatcacgtaagcatagatattgtaaattcatggcagaaccgggagcccagccggatgaataggtggagccagctaatccggcatcctgttccgctttgctatagacatgctttttcggtaggaatacaccaccgctacttacatttcgtatccaatcattagcaggcaatccccaatctttatagggaatctccatacgtcctacggcgaaatctaaacgagggtccacggcgattgttttatcattcttagagatgtaatcataatcggtaacacgttctgttacggattttttatttctgtactctccgtcaagataaggaagtccgttttcgtctacttggaatgagtttaccagttcgtaagagggttgataaaatccgcaacatccaccggggcctgtgttatgaggataattcagtaaaaatccgtaattcccgttattattggctccgacagagaattgtacctcaaaaatagactctttcccattttcggtagttgcgttaaaatttgcgtccagatcatcttgtaaggctaatctctctcctttagggcttaatccgtttgcgataatatcggccaagatcggtttggcggctgtcatatcaccttgttgcattagtattttagcctttaacgcttttgccgctgttttcgtagggcgtgccacttcggtctgtttttcgggtaatccttcgatggccgcttctacatctgctaaaatattaggatagatgtccgtaccgttatgaactttcgggtcattttcttcagcggcgatcgtctcgtcgatatagggcatgccggtcggtccgaaaatctttaccccttcgaacatgaatagggcacgtaagaattttagctccgcagtccggtaggccttggttgtctcatccatgtctgccgcttctttcatcacattgagtgctaagttgcaacgttgtgctccataatatgcgtctttccacttattctgtaaatagtcgtttgtggccgtgacggcatacgtctctacggagttcaatacggattggtcattggattcggagcctttattagcgtcacctccgtatacaccaccgaatacccaattgaacatattgtcatatccggtcggccgggtcaaaccggcataagcgttgaccaccaataactcaaccccttcagcatttgttaatgcttcttggtcaatactgccttgaggagctttatatagaaaatcctcaccgcaagaactcaaggtaaataaagcaactgcgcttattattaatattttatgtctcatactagtcgtttttatagtaaaatggatttagaaagtaaaattcacgcccaataagaatcgcatagttgtaggccagcctcccatatcgactcctctttttaagtctacacgtccggctccgtcggtgtcagaatcgctttgccgtaaataggcgttggtaaactctgggtccaagcctgtatatccggtgaccgtaaggatattctcggcttgtaaatacaggcggagattctggataccagccttcttgagtaattccttaggcaaggaatatcccaatacgagatttttcaggcgtaagaaggaggcgtcttctacgtaataagagctagaataagctccggaatagttatcttccgtattcagcataggaaggatagcattactgttatcgccattcaatgtccatgattgatctctgaggcgtgaggatttattaccgttgaaagtccagaaatcggtaaaatattttgtgttattatataagtcattgccgatagagaagttccagaacatagtaaagtcccagtttttccatgttaacgtggcgttgaggcctccggttaagtccggatgaggagagccgataaaggtccggtcgctatcatccaatttgccgtctccgttcaagtcctcaaaacggaagcggccgacataagcggcagcgtctgcctctgtgatatcactttgtccgaatggcttggttgccataacatcggctacggactcataaaaaccattttgcttcaacccccagaattcagacacggcatgtccttttgtcgtacgggttacgtatccttcgatgcgcgtaccgctagcccatagagaataatcgtcagcttctgcgagtttcaagacctcatttttataatgggataaattcaaggatagatcccatgcccagtctccttttcggtcacggtaattaaacatgaagtcgaaaccggtgttctttatatctccgaagttgatataagggcttccggattctccggccatcgaggtgtaggccgcttgtatcaacatattggatgtcttcttcgtataccattcgaatgaaccgctgaatttaccattcaggaaggttgcgtccagacccaagttgaccatcttggtcatttcccatttcgtatcagtgttaccgtaggtactgaggcggaatccggttgtctcgctattgttcgctccggtcatgtcgtaattcgtataggaggtgctggtcgtgaacaaattggcgaaattagttgcgacaggaatctctgagttacccgtgacgccgtaaccggctcgtatctttaagtcgtccagccaatctcggcttggttccataaatgcctcctctgacatacgccaaccggcggagatagatggaaagactccgtaacgattattttccgagaaacgggaaacaccgtcccggcggataataccggttaatagatacttatccttatatccatagtctgcacgggcaaacataccaaatagcgcgaattctccattgtaagtggaagagttggtacgttggctattgttctcgcccatatccaaggtgtatgtattggtattgtcttcgaataaatagttatatctacgtgcgttgagggatctgcctaaaccgtcccgaatagcctctgttcccaataagatgttcaaggaatggatctcattgaatgtccggctgaaagataacgtgttggtccaaacccaacgataattaaagtaattactttcgtaaaagttattttgaccgccggactcggagaactccgggttgtttttagtcatcgagtaagaatagtcattacgataatcgataccgaagtttgttttaaaagtcagtccagtccataggtctgcctctccatatacgttgccaaatacacgttgggtagtggcataattatccttatttctttcacgaatagctacaggattctggaaattgccggtcccggcgaataaggagcctgcataattgcccgcatagtcataaaccggtacataaggagaggcccgataagtccatgagtagatgttggactctgtacctgagaagctaagtccgttgtttttgctaaaactataagttaggttctctccgaatcgcaaccatgggcggacgttatacgatgaattagcacgtgcttgatagcgtgtgaaataagattcgatagcggtaccttgctggtcgaaatagttcatgctcatggtgtattgccctttatcggtacctccagacaaggacaactggtgattctgcatccaaccgagttggctgatttcatcccaccagttcgtatcgcctacgggcgcatagactacgttgttcgcttgatcgtaatcgctaggatcgatggaggtgctaccaccggcgccggttacggtcatgtaattgggtagatgattaacccaagagtcggaagtacttccgaattgctggtggtaaggtaattctccattggcgctggctcccgttaggtccagattgtttttcgaggcttgccattcgacatcaatacggtcataagcgtttaagacgtcatagcgtttacctgttttagagaaaccgtaatatccgtcataggttaatctcggttgtcccgtttttgttcctttcttggtcgtgattaaaatgacgccattcgctgcttgcgctccgtagatcgctgcggaggaggcgtctttcaatacttgcatactctcgatgtcattgggattgatagagcttaggtcttggtcacgagtggatacgccatcgataacatacaaaggtccgttgtcattgatggaattaatacctcggatgcgtaccatcgtggctgaaccgggagcaccggaggtaccgatgtttacgcccgccgctttaccttgcaactgttgtgtagcggaagaaccggaagacgccaatagctcttcggtatcgataaccgctacggaacctgtgatgtcctttttctgttgggtaccgtaaccgacaacgactacctcgtctagattttgggtgtcttcctttaagataatgttcatgacgttcccgcttgcaggtgtttgttgagttacgtacccgatgtaagagatgaccagaatggcattcggctctacttctaatacgtatttaccatccagatcggtgatcgttccgttcgtggtaccctttacgactacgttaacacctaataggggctctcctttagcgtcggtgatcgtacccgttattttccgggattgttgcgtaacggaggtttccgcttttaatacggaactttgcggtatgatagcaccgcctgccaataaaaagcataaggccaatcctagcctgcttttaaagatcgcatgtctgtgtttcataataaataggttaataaagtctagtaaaatgaggcaatattaaggtttgtttagacgaagaccaataaaaatcaatgaatgcctttatctattcggtgaaaaagcctttttaatcggcgaacaacttttggtggaattcttttgttttttatccgtctgggcaaagaaaaaggacaccggcaggtgtccttttctttaatgtttacctattctgccggtctgtatgatgaaccggtttgttagggctttcacaagtcctaacggtgcaaatgtaaattaaggagagaagtataaaaaatagaatcagtgaactggcggaattattcgatgaacagggttttttgttcggtaaactttccgtaagttcgcgaaataaaaatttaacatcttataatcatgcaactatccatagatcaaaaagacatcgataaatttctgatgataggcgataaagtattgatcaagcctaagaatccacagagccagactaagaccggattgtatctgcctccctcggttcaacaaggggagaagatacaagcgggttatatcataaagacggggcccggatatccgttgccttctcaatctgaggagcatgaggtctgggagaaaaagaaaggggaggaggtgcaatacttgccgcttcaagcccgtgaaggtgatttggctgtctatttgcaaaatgccgcttacgagatcaattttaatgacgagaagttcttgattgttcctcattccgctattttgatgttagtgcgtgatgaaggtttgtttgaataaagccttttgttaaggaaaatagggctatattcacttttttatcttatttttgccagcaaaacaagacaaactatcaacagtagcgattataatgaataagattgtaagtaaagaacatttctcagccaacgtggtgaagctggaagtcgaggctcctttgatcgcccgctcccgcaaggccggtcacttcgtgatcgtgaaggttggcgaaaaaggcgaacgtatacctcttaccattgccggggcggataccgagaaaggtaccatcaccttggtgatccaagcggtaggcggctcatcccgtaagatctgtgaattgaacgagggtgactatatcacggatgtggtgggtccgttagggcaggctacccatatcgagaaggttggaacggttgtttgtgccggtggtggcgtaggtgtcgctccgttgttgccgatcgtggaggctttccataaggcaggaaatcgtgtgatcgtcgtattggcggcccgtaccaaggacttggtgatccttgaggagcagatgcgccaaaactcggatgaggtaattatcatgaccgatgacggatcgtatggtatgaaaggcttggtgacgaatggcgtggagagcgtgatcaaccgggagagggtggatttatgcgttacgatcggtccggctattatgatgaaattcgtttccgctcttacaaagaaatacgagattcctaccgtagcttccttgaatacgatcatggtggacggaacgggtatgtgtggtgcttgccgtattacggtaggcgggaagaccaagttcgtttgtgtggacggaccggagttcgatgctcatcaagtggattttgatgagatgatcatgcgcctcggcgcttataaggatatagagaagaaataacgaaaccacgtaattgaatcatgacaacagaagaattaatcgctgctcgtcgtgccgaaccttggcgggaggcacttcgcaaaagcaagaaaaataaagaacgtgcggatatcccccgtgtgaagatgaacgagttggacccggaataccggagtcgtacccgtttggaggaagttaacttaggcttgacaaaagaacaggccatgcaagaggccgagcgctgtctggattgtccgaatcctacttgtatgcagggatgtccggtaaatatcaatatacctacttttatcaagaatatcgagcgtggggaattcttggaggcagctaagactttgaaggagacaagtgccctgcccgctgtttgcggtcgtgtatgtccgcaggagaaacaatgtgagagcaagtgtatccatttgaaaatgggtaaggaagcggttgccattggctacttggaacgtttcgccgctgattacgaacgtgagagcggtaatatctcggttccggagattgcggagaagaacggtatcaagattgccgtggtaggttccggtcctgccggattgtcttttgccggagatatggcgaagcgtggatatgatgtgactgtgttcgaggcattgcatgagatcggtggtgtattgaaatatggtatcccggagttccgcctaccgaataagatcgtggacgtggagattgatggccttcgtaagatgggcgtacagtttgagaaagattgtatcgtgggtaagacgatcagttatgatgatttgcatgcggatggctttaagggcgtgttcgtggcaagtggcgccggtctgcctaactttatgaacattccgggtgagaactttgtgggcgtgatgtcatccaacgagtatttgacccgtgtaaacttaatggatgcggcgaatccggaaagtgatacgccggtgctacaagggaagaaggtggccgtgatcggaggtggcaataccgctatggactctgtccgtactgctcgccgtctgggcgctgagcgtgctatgattgtctaccgtcgtagcgaggaggagatgcccgctcgtttggaagaggtgaaacatgcgaaggaagaaggtgtggagttcttgacgcttcataatccgattgaatatataggagatgaaagaggtcgtgttaagcagatgcgcttgcagaagatggagctaggtgaggcggatgcctctggtcgccgtcgtccggtacctatcgagggagctatcgaaacaatcgatgtggatgaggtgatcgttagcgtcggtgtatctccgaatccattaataccccgtgcctttggaggcttggaggtgagcaagaagggtacgatcgtagtggaggaagacagtatgcgctccgctttaggcgatgtgtatgccggtggtgacatcgttcgtggtggagctaccgtgattctggcgatgggagacggtcgtaaggccgccgccgctatggatgcggacttaagaggataagtataatatctattagttctataaggaaagacgggttgtttggacgatccgtcttttttcttttatcgtgatacggagatttatgtttattatctataagactaattcttgaaataatctctcaaatgtctgttctagatcgttggaaaaaccgggatgtggacgcgaggtttggatagaggcacttcttatggcggtaagccaacgaaagcgctccggaatatctaggctggctataggacctccatcctttgcgccggaacatatcttatcgaaaacgtggagattcgtacacaaagattctttatctatatctgatgtgaacagacgaagtttctcctcgtctacatgatagcgagccttgatgaatttaggccgtttacagaacatgataaggcctacattgataaactcctcccgttcgattttcggcacgatacggattacggcatattcatataagtgtttgtcttgcatgtcgagcttcatttataaacgtgtcagaatgggcgattcggtcaattaaaaaccggatatatacatcacgtatctcttgaggcgtaccgggactatcgttccaatgcaaccaatcgtcgggtactagacctacgatctcacgaattttctcttcagttaagatacgtttgaaatctttgtttacttcctccagcagcgtcgcttgtggcaataatacatgatccttgatatggatgaaagggccgatcgcatgtttttgccaatttacccatgagaaatggaaaaataaggaagctccatgatcgatgagccaaagttctttattccatatcaacatattcgtattccggaccgtgcggtctatatttgtcaaaagagcatcgagccatacgacttgtgaggcgagtttaggatctacacgattgactaccggatcgaaagtcaaggctccggataaaaaatgtaatcccagattgagcccttgacttgcttgtagtaagtcttgtatctcctcgtcaccttccgaccgcccgaaagcctcgtcaagattcaggaagaccaattccggtacatggaaacccaagcaacgagcgatctcacctccgatcacctcggctatcaaggcttttgtcccatgtccggctccccggaacttaacgacatatttaaactcatcgtctgcctccgctaaagcaggcaatgatccgccttcccgcagaggcatgatatatcgggtaacattcgctgtacgtaattccataaccctcactttaattgaagataaagatacgattatattttagaaataaaaagccccgctattctttcgaacagcgaggccttttggaagcgagcggaagacgggactcgaacccgcgaccctaaccttggcaaggttatgctctatgaagtgaataactaacggcttgtcgagtgaataactaacggctatacctagccgttagcttacggcttgggaagtgaataactaatcacttggaaagccttttacgagtgacttaatcaactgtataccagacatatttcacaaacacattttacgactcaactagctcttctactaaattaaagaagaaccagaaaatgtaggtatagtcagtcaaaataaagctagcttctttaaaagagcataacaaatcgcaacacggacacaagaacttgaagaaatatatcaactagtataaaaatgagcccgatagaataccgagcccattaaaaatatagaatgtttaatttaacccccaatctatcgggttcacttttatgagacaacctcttatttatgcatctaatttactaatatcaaaaagagggcaaaaaggctatatgaaaagtctcattctgccctgttgccggacaatagccacttacatcaatactcgttccaattatactactaaatcctgtacctgcgcaattcaaggttacatgattatttgaagaacctataatcaagtccttaatagttgatgtaaatgtataggaggtaagtactggagaagtaatataaacagaaatcgccgttgttcctgcaggaatatgcaaattacttccaattgagaaagtagaagatccggtagacgcctcataccaaccttccacattgtaaatcacacgagcctcatctactatattaacaacaggatcaactggttttactgcaaacgcaactaacgtacaagcgaaggaagctaacgcaaaataaattacctttttcataatatttaattttaatgatcttagatgaagcttacgcctcatctaagattcctgtttagaaacttgcataacccggattctgaaccaagtttggattggtttgccatgcgtcttgagaaacagggaatatttttaaataatcatctgtttttctttcacaattggattcagtccacattcctttagtaaaacagccaaaacgaatatcatcctgacgagaaaaaccttcccaagccaactctaaacggcgctccaattggacctccttcaacgttatggttgaataattatgggtgttatttccataagcacgttcacgaatagcattgactaaatttgtcgcttcagcaacactacctccactacgaagcaaagcttctgctttcattaaataaatatccgctaaacgaaatagatggaaatcgttctccattgccgtagataaagatttctcatacgtccatttttgacaacgagctccttggtcttgataaacagctccccacttagttccatccaattcagaacccggaataatactaatatctacagtataatccagcgggcgattctcgtctgtaataattttttccccggttgagatatcatactgttggccgattaaataagtaccttcataacgaggatcatcctcattgaataatttaacatagtctggctgagcacaaatgccattccaaacactaatactagctcctagagccaaaccttgcttataatgcaacgtacgtctataaagaacattttgatcctctgtatctgtacttgaataagacgccgcaaagatagcttctttagaagtattattattgggatcaaagtttgttttccaattaggctccaatatgtatggcattgccattaccttatcgcagtattctataactttactgttagcattctcggagatattaacaccccaagcctccgcattttggtacatcttagctaaaatcgtataagctgtccctttagtaaaagttccatatttttttgtatcgtaatcaggagcttctgtagctaaagcattcaactctgttatcagccaatcaaatacctcttgacgagatttgcaagttggtaattccttatcattataatcaacaaccaatggaatatttccaaagaaatccatcattgaataaatccagaaagcccggaccccacgaatttccgcaactttagatgttttctccgcatcactcaataaagttgaatttttcaaaacctcgattgtcgcattacacgtaccaatacattccgaacctatactccaacaactttttacacaactagtattcgcagtccatgtatgcatataaacttcacggtactgtcccccatcataccagtcacctccattacgagttacgttcactgttgacgaaccagaattttctgcgaggatcatatagtctccggaatatttttttaacgtattataaaccgtaccaaccaaggcgttaatttcagtagttgtattgccaaaattttcagcaggtagtttatcgtatacttcctcgtccaaattcatacaggacggcatagaacatagtaaagccgcaccagtaagaaatgataatatagtttttcgtttcataatatattttccttatttttattagaatgttaagttaacaccaaatgtaaatgagcgagatttcggcatgtaatcacgaggttcaatacccggagacaagccagcatcatcatcacttgcctgaccacggaacagttctacctcaggatccaatcctttgtaacctgtaatcacgaataaattctgggcggcaacataaatacgtgctttgtctaaccagtcaatctttttagtattgaatgtgtatccgatagacatattatccaaacgagcgaatgagccattttctacataataagaacatacacgagagttctcacgcaatttataagtaagttcatcattcatcgcatttgcaccgctcaaataagtattattcgcataggctgcacgtggattatccaaaaccttattaccgattgttccacgtataaagaaactagcatcccaatttttccatgagaacgagttattccatccgaatgtcaaatcaggttgagcgtcacctacatatgtacggtcatcatccgttatctgtccatcaccattgatatcttcgatgatatacttaccattctcatcaataccatcacatttcagcataaagaactgacctaccgggcgaccttcttcaattacatgcgaagtcacacccgaagcacctctgatccaaggatctcctgtataaatacggcttgttgaatacaagtcattagacagcttcgtgatcttgttcttgttatgagatagattaatagaagtattccaattgaaagtcttattacgaataacatccaaattcaacataacttcaatacccttattgctcatgtcacccacattcgcttgaattgtactatatacgtatgttggagtaggtactttataacgatacaacatatcagaagttttcttgtcatagtattctatcgtaccaccaagacgtccattaaataattgaaaatcgataccaacattaaacatcgcagtagactcccatttcaagtcaggattagcgttctgtgaaaccctaaatgcggtcaattgagagccatcattatagtatgtaccttttgcctcgtaaagctcaattgatttataaggttgtaagccatcttgatttcctgttataccataacctgcacgtaatttcaaatccgtaagccaattaacatcttgcataaaagcttcctctgaaataccccaagctgctgaaacagaaggaaatgtaccccatttattattagctccaaacttagaggagccatctcggcgaactgtcgctgtaatcatataacgctctttataactatagtgggcacgagcaaacatagagatcaatttataatcatttttatcagactttacattacctacatccaatttattgcctgtttgcaaattattagcacccattgaactaacagcgaagtctaagacctttgcctcatgactagagtactgattatcctcccatgaataacctataatcgcatcaattttatgttgttcttccgaaccaaaagctttattataattcaaagtccactccattaattcgcggttccatgctcttgaacgccgaatagccaaaccattaccagcatcaacaccaatacggttagcaggatcctgccattcactataatcattagagaaacgacttttatataaattagccttaacattcaatccatcaataatatcaaactgaagatctccctgaccataaaaatacacattactattctttttatagttctgatcctgattctgtacagggttaccttgatcataaccatcattacgaataaagtaagaaccatcttcattaaacggagccagaactggagacatattatatgcgtaaataaagtttgtttggaacggcatttgcatgtctgtcaatgttgcagcaccggttaaaccaatacgcaaacggtcattaatagcgcgttgttggaactggaaacggaaactatggcgtttcatccagttatcacgaacaataccagtacgatccaaataagtataagacgcccgataattattctttgaacctccaccggacattgaaatagaatgattttgcgaaactcctgtacgaagaacttcatcaaaccaatcagtgtcattattatagccatcgaatacacttatatccttacctagctctttatttagcgccctccattcagaagcatttaacatatcaggtttgttagctaccatatccatggtcacataaccatcatagttgatctgtgttttagatccggagcctctcttggtcgtgatcaagataacaccaccggccgcacgagaaccgtagattgccgcagaagaggcatccttcaatacggagatagactcgatatccgtaggagatacagtggacatatcaccacccggaacaccatcaataacgatcatcggaccttggtcattctgcaaggttgatgtaccacgtaaacggatttgggagctacgggtcacgtcgcccgatccagatgtaatcgtcaaaccggctaccttaccttgcaacaaatcggacgcatcacgagtaatacctttattaaaattctcctccgaaacatttgctacagatcctgtaatttccttacgagtctgcgtaccgtaaccgatagcgacaacctcgcctaagtttaccacagaaggagccaatttaacttcaacagtcttacgtcctttaaccccttcctctaaagtgttataaccaataaaagaaaattgaagaacggcttttttcaagtcgttaagcgttagagtgtaattaccgtcaatatcggtaatcgtaccattggtagtacccttttccacgatgttcgcaccgatgatgggttcaccaagttcatctagaactgtttttcttcatctgcgtattatttgttggcgataaagataatacaaaaaggcgaagtggtcttttttcgaagatatacttcgatgccacttgaagtatatcttctccggacataggatatatactgcatcggcaaagtaagtatgacctcaaaaaaaacacgtacgtgttttcaaaaaaagacgtacatgttttcggaaaaacacgtacgtctttttttaaaggctttatagagtctgattctacctagtacttgaagcttcctccccccaagaattcacggagcaaggaagttccgggaagttcctccgtcgggatgtaattaaagtagcggaggaaacggagcaaacgatacgcctccgcattcgccttactactctccggcacttgtgcgaggatcggttccgcgaatttgcgcaaggcggccagctcatacaacatggcgctgttaaacatagcgtccgcattctcctgatagggaaagatccatttgtcctcaccccggcgaacactcggccaacggttgatcgtatcttccgccgaatatcccctaaagcgataatcccggatgatacggcgcagcaggcgattgtccgtcgtgggtatccagttgtggttatccaaggagatagaggtcaagaccgagacatacacccgatacttatatttatcgtcgataaactccgtcagttccggattcaaggcatggataccttctatcaccaagatcgagttctcacgaagcttaagcttcttccctttgaaaacccgttggccggtctcgaaattaaaagtcggcaaatcgatctcttccccggataacaacttcttcaaatccttattaaaatagggtaaatccagcgcatacaaggattcaaaatcatactcgccatgctcatctttcggtgtatcttcccgattcaagaaataatcatccaaggaaattcctaccggatgaagcaggttagttgtcaattgtacttgcaaacgcttgcaaaacgtagtctttcccgaagaagaagggccagagatcaagacgatacggatgccctctttatatccatcggcgatcttttcggcgatcttagcaacctgtttttcctgcatcgcctcagagacaaggattatatcctgagagcggcctttctctatcgctaaattcaaatcccccacattatctaagccgacagtccgctgcaatgtaaggtgttccttataagcctcgaacatcttatcctgcttgatgacaggctgcaattccatcggatcggtctgcttcggaatacggagcaaaacgccatccatatacggttccaagtcaaacaattggatatagccggtcgaaggggttaaacagccataaaagaagttgatataaccttccaactcataataagaggtataaggcaatcccgccgtctctattaagcgagccttatcattcataccccgctccctgaacaatacggcggcatccaccgtacggacactcttatggaggaaaggaagatccgcgtcaatcaactcccacatacgtttcttgatcctctcgatcgtctccagatcgatgttcttgccgttatggatcacgcaatagtaacctttcgacaccggatgttccagatttaaggtcgccgtcggccaaatatcatacaccgccttggaaaatatatggcaaagcgagcggacataggttctcaatccggataattgagtatagtcgataaattcgatatccttcggttgccagcaacggaagttcaagctttccgtcttattattcacttgcgcgttcatcggcctgtaccgaagcggagcgccaagcgccgtataaatgtccaacaacgaagaaccaatgggtacatccttgtaggtattattatttttgcagtaaattgttattgtctcagacatactatctcagttattatttgtaaattcgccccctaaagttaggaatattaatcggatatacaatccacttaaacgtaatttaaatggactattctttttttgattttctccggctgatcggctccttggcgctgttcttgtacggaatgaagatcatgagtgaagggttacaaaaatttgcgggtgacagtttacgtcgaatactaaccgcgatgaccacaaacagagtgaccggtgtgctcaccggcgtgttaataacggctctcatccaatcctcatcggctacgacggttatggtcgtgagtttcgtgaatgccggactcttgacattgacccaatccatcggagtcattatgggtgccaacatcggaaccacggtaacggcatggcttatctccgccctcggtttcaaggtcgatatcgccgcattcgcccttccccttttagctttcgctctcccactcttcttctcaggaaaaagctctcgtaaatcaattggtgaatttgtctttggtttcgcgttcctgttcatggggcttcaaagcttaaaggcaaacgccccggacctcggagcgaatccggagatgctggctttcgtgcagaattatacggatatgggatttttctccatcatcttgttcttatttatcggagcgatcttaaccatgatcgtacaagcctccgctgccacgatggctattacattgattatgtgcgccaacggctggatcgattatcatttgggagtcgctttggtattaggcgagaatatcggaaccacgattacggccaacttagccgcattaaccggaaacacacaagcacgacgagccgcgttagcgcaccttgttttcaacgttttcggtgtcatttgggttttggtgctcttctaccctttcacgaatgccgtctcatggtttgttacccatgtaatgaaggtcagtgatccggctgtggcggtatcctttaaactggcagcgttccacacagcattcaatatcagtaatactttcattatgatctggttcgtaagcttgatcgaaaagaccgtatgtacgcttatcaagcccaaggtggaagacgaggaataccgccttcgctatatcacgggaggtatgttatccaccgccgagctttctatcctgcaagcgcataaagaaatctcattattcgccgagcgtacggctaggatgtttaatatggtgaaagaattattctacgagaagaatgaggagaccttcctcaagacttatagccgcatcgagaaatacgagaatatcagcgaccgcatggagatcgagatcgcgaattacttgactgaagtatcggaaggccgtttgagttctgaaagtaaggaagaaatccgtatcatgctacgtgccgtctcggaaatcgagagtatagcggattcttgtaataaccttgcccgaagtatcaaacgcagaaacgagttcaaatccgaattcacggaggagcaaaacaagcacttggatcatatgttcgagctggtatccggggcgttaaatcgcatgaacctaattttgcataaaccggaactcgtacatgatgatatcaatccttcttataacatagagaacgagatcaacaactaccgtaaccagttgaagagccggaatatcgaagatatcaacaataagctgtaccaatatcaagatggcgtttattacatggacatggttagtgaaagtgaaaagctgggcgattatgtattaaatgttgttcaagcggttatcgagaagaaaatatagcgtatatttgtccttaacaatatcaacagcccttttccgttattgagagaagggctgtttttaatatatatccactatgaattataagtattatacgatcgttatccttggccttttagcattctccgcttgcgagaaagatgatatcgatattccggcaaccgacaatgaagtaaatcaatggatcgagcaaacgatgcgagagaattatctttggtattccgagttaccggataaaagttccttggactttagtcttgatccgaagagcttcttcaagggcctgttatccgataaagacgggaaagagctttctgatggccatcattacttctcccaattagagaaagcgaccgtaacaaagagcatttacgacgcaaacaactcatacggattcgatttcgcgacttccaaccttaaagacggaggcagtacctataaaatagccattgtcctttatgtattaaaggattcacccgccgaagaagccggattgaaacggggagactggatacttggcgtaaacggctccttgggttctatccaagactatgatgtgttgagaagcggaggcagcgtatccctccaactaggaaaagaaacaggaaacaccaagggattcgtctccacccgaagagttaccttgaacgcatcccgaacggtagaagacaccccattcctaaaagattccgtatacacatatggcaataagcgaatcggctatttgatgtacaaccatttcgcctccggaccggatgaatacgattatagcgacactagttataatctttatttgcaacaactcttcgaaaaattcaaaagtcgcaacgtcaatgagttcgtacttgatttacgctataatgggggtgggcttgtcaattgcgcccaattactggcttcgctattagtccgtgaaaacgttttaggagaacctttatgtatcatggagtataacgataaaaactccaataaaaatgagaccttacctttgctcaaaacgaccgaggtcatggcgggaaacttaaacctacaacggctatttgttttgacaggttcaactacggcttctgcctccgaacttatcattaactcgctacgatcttatctagacgttcgggttatcggtaagcagacttttggcaagaccgtcggtatgacgatctacaatgaatctaaaaaatatggttggatactttctcccgtcactttccatatttataataaggatcgggaagctgattatgaagacggatttcatcccgatgtagctatcgatgaattcaagagtgatctagctgaattcggagatttgaaggatcctttattaggacaagctatttacgagataaccggccagtcaccgctcttacgatccgctaccccgaggggcaaccgggaaatccaatataatcccccgttgtcctataaggataacttattactgattccaaaagactaaaaacaagatatatggaaagcgcatttcttaaaatcataaacgcaaaagtattaactccttcgggtctcctaccaaacgggcaaatcatcatctcggatgggaaaatagtggagatcaccgggcaaaaccgggagattcctcatgcggagatcatcgacgcaaaaggatattatgtggctcccggctgtatcgacacgcatgtacacggcggcaacggacatgatttcacggaagctaccccgaaagcgttctatgcgatcacaagagcacatgctttacagggaacaacggctttatatcctacattggcagctgcccctatcgataccttccgggaagcgatcaagacctgcgagcacatcatgaaccacccggaacagggagcccgcatcatgggattacatctcgaaggcaactatttgaatatggctatgaaaggcggacaagaccctaattatatttacccgcccgatccccaagaatataaggaattactaaacagtacccaatgtgttaaacgctggagcgccgcccccgagcttgacggggctttggaattcggtaaatatgcgtcagctcatggtgtgttggtttcactagcccacaccacagccgattatctccaagtgaaaaaagcatacgaagccggattcacccatgctacccacttctacaatgccatgacttccgtccataaagaccgtgagtataaacatgaaggaacggtagaaggtatttatctcatgaaagatatgaccgttgaagttgtagccgatggtatccacgtaccgccggcaatcttaaagttggtatatcaaatcaaaggggtagaacgtacgtccttaatcacggacgcaatggccgccgccgcttgcgataacggtacggaacattttccggactcccgggtaattatcgaggaaggcgtatgtaaattagccgatcgctcagctattgcgggaagtatagctaccggaatccgtttgatccgtaccctagtcgagaaagcggaaattccattgcacgacgctgttcgtatggcttccgaaagcccagcccgcctaatgggtattttagaccgtaaaggaacattggagaaaggaaaggatgccgatatcatcattttcaacaacgatatagagattcaagagaccttcatcgaaggtaaacggctctccaaagaataagaaatccaataaacaatgacttctcctatcttgtttttagataaataagggcatgaatgtatatggaaaacgtaaaagaacattactggagatactcattgatcaccattatattaggactaggggtaattctattttttaagattaccccgtttcttggaggtatacttggagcattcaccatctatatattgctgcgtggacagatgttccatctgacagaaaagctaaatatgagaccggcttttgcagctttactgttactgggggaaacaatcttatgtttcttaatcccaatcacattggcgatctggttggtaatcaacaaaactcaaaatattaatttagacccgactgtactgctaaatacaggccaacatatagcggatctagttcaggaaaagaccgggtttgatgtactggatagaggaaacttattaaaagtggcctctatactcccacaaatcggacagtttttagtgggtagcataagcagtttcgccgtaaatgtcgtcgtcttgattttcattctgtacttcatgttgataggcggaagaaaaatggaaaactatctatacaccttattccccttcagtgatcaaaacaaggatgaggtactcaacgagatcaatatgatcgtaaaatcaaacgccataggtatccctcttttggcggttatacaaggtatcgtagcggtgatcggttactttatctttcagactcccgatccgctgttatttgggtttctcacttgtatcgctacgatcattcccattgtagggaccgcattggtctgggttccgttggcggcttatatggctttaaacggagattgggtacatgccttaggattggctatttatgccttgcttgtcattacgaacgtcgataatctgattcgttttatcctacaaaagaagttggcggatatacatccgttaatcaccgtcttcggagtcgtaatcgggttgtccttattcggatttatggggatcatcttcgggccgttgttattatccttattccttctttgtatagatatcttcaagaagagctatttggataaataaagagtatctacaggacagggtatcttaaaaagtcatacctttacactacattttgagtaaaacaaattaatatgtcacgtagaacagtaaacaattggaagcctatcaaggggcaacctctcaccgaattagacaagaaaatcctatatatccaaaataaaggacatttagtacccacccgcaagcttatcaagactccagagcagattgaaggcatccgcagaagtagcgtgatcaatacaggggtgctggacttaatccagaaggagattaaagaaggtatgtctacagctgttatcgataaattggtgtatgattatacggtagggcatggagcgattccagcccccttaaactatgaggggttccctaaaagtgtatgtacctctatcaacgaggtcgtttgtcacggtattcccagtgagaaggagatcctaagagacggtgatattattaatgtggatgtctcaacgattttagatggttattattcggatgcgtcccgcatgttcatgatcgggaacgtatctccggaaaagcagaaattggtacaggtcgccaaggaatgtctggagatcggtatgaaagcggcgaagccgttcggattcgtcggtgatataggcaacgctattcaaaagcatgcggagaaaaacggattctctgtcgtacgggatttatgcggacatggcgtcggtctggaattccatgaggaaccggaagtttgtcatttcggacgaaaaggaactgggatgcttttagttccgggtatggtctttacgatcgagcctatgattaacatgggtacttggaaagtatttatcgacgaggaagacggttggacggtcatcaccgaggatgaactaccctccgcccaatgggaacataccttcttgatgacagagacaggattggaaattcttacctattaatatctaatgctattaacgcttccgggccttttcccgggctaccttttccttttcccgcaaggcttccttgcgggctttttccttctctttcaatttttgcttgtataagcgttccttctccttgcgctctttttccttctgtttcaagcgttgcttataagcacgttctttttccttacgaaggtcctcacgagctttcagtttcgccttacgatccgcttccgcttgtttcagcttagccttgcgatcagcttccaactgtttctctcgatcagccttcgctttcaacagggcacgttcttcctccgcttgcttcttgagaagttcttcctgttctttcgctttctgctcacgtaattccttatccgccttttgctgagcctcgaaagccttacgagcctcttccttgcgggcttcttcttcggcagcttcccgtttacggatctcttggatttctttcaaggtcatgccttgatcctcaaccgccggctgaacaacaggaaccgtatccttacgaagggtatcgacaggctggatctccggtttgtcaaacgcagggacctcaatcgtatccgggacgactggtataggctgtatctcgggctgtcggacaggttcttgaacaggccgttgttcctcctccggctctgtaacaggttgtttttccggttcaacttctagtttcaattcatctgcctcttccggaacttcggcttcttcctccgtgatcatttcatcttcagtcgcctcctcctccttagcggcttccatacgggctttccaacgacctgccagatccggtaattcctcaccgaagctctcatcgaagaaggtgatatattcatccaaggtcttgccgcacatcaaggtctcataattatcatcagagatcggtaacacggcaaccgctttattcaaggccgtagcatagccatccttaccgtatatcatcttataatattggataatctcgtcaaaactaataaatcctttaatcgccagcatactgatcgggccggcctgctccaaagccaaatcaaactcttttaccatgaagttcgcgaagttataagcggcgacaacgaatagcaactggttctgatctacgctacccgtaggatataccaaaagcatctgataaggcgtgttccgttccggattaaatacacgggcagaatcctcggcagataacataccatcctcgcccaaaccgaatcgtaagttccaactcatacctttcacaccgccctgcaccaaggcacgtccccgaagaacacctttcaacatctccccggccagttccgtgacatccgcgttcggatacttctcgaccagcgctttcaaggcattcttaaacccttccgcatccccggcctgcacatatgataacgcatccaagaacatgaatttaggcatcaatgtagccaatggatatttctcgcttacgtaccggaaactcttacgtacatacgctgtatcgctctccagatagcggtcgtaagtagcttgatagatcgagtcttgtaccacatccatcatgcggatattatactcgtaattcggatcagccacagctaccgcataatcgctttccgggaaggcgttcattagtttattcttatactcggtagccaacgctgtatttccggttttcaaggccatcaaatatacttgataatagctctccaaacggtgctcattatccgggaaacggcgttccaaattctcgaacgcctcgacagataaggggatatcttccaacttatctttatagatcatcgccatattgtaaagaccgtctataataataatgttagaagcgtctatatcctcttgcgtgaaaggtaactgctgtaggtaatactcacgggtatgcggatcatcggcggcaacagccggcagatcaccgcctatcgaatcggtcggcaacggctcaccgtccggccctaccatttgggtggaatctccctcggccagcatctcctcatccagattctcattaaaggtagagagttccttcttacggcggcgccagtgatcttccaacggacgacgtccccatttacgctggaactgtgtctttccttgcgctacagtctgagggttatagaaatagaaagacgctccaccggacgcgttcggcaagacaacagcgttggtttccgtaccgggacggtcgattccggtgcctttcgcttcctgctcggccagataagcctccttctcagccaaggctttcgcctcttcctcctctttctttacctcctcaatcttcttatcgataatcgctaaccgctccgcttccggtaatttagccaaggcttgcaaactgtcttgaagatggaccgcttctacatgcacgaccaattcatccagaatcgccgacaatttagaaacccgttcataatccctgtattccttttgaattccggctaaggctccgctaaagcaaggttgcgctttcacgtaatcccgcatcgtaaaatagatatctcccagctttatctggcagatcgccttatccattccattcaatgtactcttatcgataccgagttgatagttctttatggcattcaccgtatcttcccggctgaggtatacatttcctaaagcatagtatacttgatccagataatccttattcttctggcttttcgccattttctcgagcatcttcaccactttcaagtaattcgtacccgagaatacttctgtctgacggatacgtgaggcaaattccaactcatacggaggattcgaacgggctacctcaccaaaggtcttataagccaagccatctaattcttgatccgcatagatttgtcccaaaagatacttcatccgggtacgttgcttccggtttttctccgccttgatagcggtcttcagataagggatggcatcctcgaactgcccgttcttgatcaaataatcggcatacaccgccgcatattgcttcaaggcggaagcaggaataccgttcttgttcatcttatccaagatatcctcggattcatagaaccaacccatctcggaataacaacgggcttgccacaaacgggcctcggccacgacctcctcgtccttcgcgtaatgacgggctatataggagaaggtagcggaggcttgcaggaaatcggcattgtagaattgcgcctgtcccatgatcagccaactattctttaagaaagggttatattcctcttgttcttggatagcacgtagtttgggattattccgccagcccggtttcttggccggtttcgcttttatggagtgtagtttaatagctttattacttttctcgatcgtccggtcgaaagggccgcccggctcggctttgtctttaggctgggcgctaatcggatacatatagatcctgtcggaatagttctctttatatccgtcctgttggcttttcagtgcctcgtcaaacgcttgttttccattgaaataaatattataacgggttgtaaaggcatgataaaaacggctcgctttcgtgttcttcttcgtactgcacgaccaaagcaagagtaccgttaataacgccactatgtagtaaaacccttttttcattctttaattaacgccgtaacaacggttttattgctttcaaggccaaaaagaggaccaccaaaaacaagatgataaacgcaccggaaggcacgttcaggaaataagaaagaaccagtccggagacgcaacccagaaagccgatcacgatacttccccatatgatcttcttgaagtcggaagtaaacaggtttaccgttatttgcggcaaggtcagcaaactcatcaatagcataatcccaaccaaacggatcgaaagaacaattgtcatggcgataaagcacatcatcgtatactcgatccattttaccggtaggccttgcgtgacagcgaagtcacgatcgaacgccacgtaaacaatctcacggaggaaaagggagaatatgagtatcaacaataccaccaaccctaaaatccataagatatcggccgtagagatcgttaatatattaccaaatagataggcggatagattcggggcgtaccccggggtaagaaagatgaagatcactcccaaagccatacccagcgaccatacgcccgctatagcggaatcctcccttacgttttgcgtcttgctcgcccactccacgccaaaagcggagaggatggagaacagcatcgccatcaagatcggatttgttcccagataaaaacccaagcccaaaccaccgaacgaagcatgcgtgatccctccgctgataaataccaaccggcgggatacgatgtaagtcccgacaatcccacaagcgatagcggttagcaagctcccgatcaaggcgttctgaaaaaaggcatattgcaataaatccatatgattcgtttcctaaattaatgagtacggcgttcgccaatgatcaagaatgcctcatccttcaaggcatccggcaaattgatccctcgcaattgcaggctacggagccaaccggccacctccacttcccggagggtataaagcacttcactaaactcctcaacggcttcctcatcgtaagcgtccgcttccactccttggaaccgatccagttcctcatcgttataatattcgattttcttgctgacggcggctaataaactatcccgctcgcaagtctcatgctgtccgcagcaaacctccgggatctcctgtgcctcggggatctccgagatctccccccgttccagcatcttctgaagtttcttattccggaaatacccggcgatagcggctacgacacccagacctataagacttatgacaatgtaccacataattcaattgaaagttgagaattgaaaactgaaaattaaagggctgattccctaatagagaaaccagcggccttaagatcttcccaataatggggataactcttgctgaccacttgcgggtgggcgatctctatcccctcgggacgtaccaaagcggcgggagcgaatgacaaagccatccgatgatcctcgtaagtggcgattaccggatgcgactccggttccctgcgttcaccgttccactccaagatgctatcattgcgatccgtcaacacataacctaatttacgaagctctgtcttcaatgcctcgatccgatccgtctccttgatcttcaatgactgaagtcccgtaaagcggaaagggatatttaataacacgcaagtcaccacaaaggtttgagccaaatccggttcattcacgaagttataaaccaacttctcacagatatttccagtatgctttaacatgactccacgtttcgtataagtagtgcccactcccaattgagcgaacaacttcgctccggcggcatctccctgcaagctattcttgaataaacctaacaattcgatctcagcatttttcgataacgccatgatctcataccaataagaagcggcactccaatcggattccaccgtaaaacgaatcggcttatactcttggggaagtactttgatcgtattctccgtccaagaggctctcactccatattgctccatcaattgcaaggtgatatggatatagggcctagagataatagcgccctccaaatgcaacgtaaccccactttctgttaagggggcgatcatcaagatagcggatatatattgagagctaacatttcccggtagcgagatctctccgccttgcaaggcgcttccgaaaatacgcaaaggaggataaccctccttctccatgtactcgatccgggcgcctaaagcgttcagcgcatccaccaacaccttgatcggacggttcttcatgcgttcggttcccgtaatcgtccattcgcccaccaccttcgagaggaaagcagtaaggaaacgcatcgtcgtacccgccgcacccacattaaaatcccgatcgttcgagttcaatgcctttaccatcaaatttgtatcatcgcaatcggataagttctccacatcgtatgcgctataacttagcgcattcaagatcaatgccctgttactgatacttttagaagcgggaagctttacggtagtccggatagcggaacccggagcatctatctgataattcatcgctttcgtatattcaagattcaagaggcaaaagtacgaaaattagcgtacatatggagtataacagcgggaaactttctttatgcttcttttcgaatgcgaatcgtgacaaggcattcgtttgaatcgccccaaccagtagacgtgaagggcaataaaacgcccttttaagtgagaatattcccgttttcaggcacgaaaggcgacaaaagcctacacgtatagtcgcgttgggcgacgccaatactgccgttaggcattataaacagtcacgaatagggttgtcagtagtcgtgaataggcatcgtaacccggttagaacccagtcgtaaccctatcagatagcccgaagaagtcaatggatatgaattaggatgaattattttcgctagaatgaaaggcggtttttcggtattgtattatcaatgaacgaattattgtttttttcttgcgtattaggcaacgagtcgtacatagtcccggaaaaatcggttctccgggactttagtttacaaaatgtcagaatgtcaaatcgccaaacggtcttatcacaaggccttcatcttcaggaaatgcttccagaaaaagaggatctggtaatcaatagaattattccagtattgtgaatcatgattacccgggcgagtgataaagtcgtggtcgatgccttgttttaataacgcctcgtggtagttcttattcacctccaaaaagaaatcgctgtcaccgcaatcgaagatcaaagcgatctggtctttcctcaaggttggaaccaaattgataaccgtgtacttctcccagttttccggatattttgctttctcacctatttgtacgctcatctcccagtttttcgggaaagggcggatatccacgccaccgctggtacttcccgccgcggagaaaacatcgctatgacgaaggccattccacatagcgccatgtccacccatgctcaaaccagtaatagcacgtcccttacgatcggccactgtcttataatgggaatccacgtatttcaccaactcatccgagatgaaagtctcataccgtacatcagcgttcaaagggctatcccaataccacgtattcttaccatccgggcatacgaaaaagatacccttctcatcagcgatcttaggtagatccggcttgataccgacccatgtacgagcgttaccgccatagccatgtaacaaataaatcaccggacacgcttccgtcgcggccatatccggacttaccacgactacctctatacttttattcatcgaaggacttttcacttgcaaagtatctaccttcgctgcctgtaaaccgagcggaagcaaacaaaccaacgctaccgctacctttttcatccaattcatatcagtgaatattaatgattaattccccgtagccttgttttcaaggaactacggggacaaatatacagattttacagccaaaaacttatttacttaacgagaaaggacgatcctctttcgcagttcctctcgtcttctccggttgattgcccatttgaagctccagcacgcccccattcacgatatcgctgtaatggatataattacgtgtatgtctcttcccgttcaaggtagcgttttggatatatacgttatccttactattccctttcgcctcgatcacgaacttcttgccatcctccatcgtaatcgtagctttccggaatttcgggctacccaatacatactcatccgtccccgggcaaacactgtagatacccaacgcgctcaatacgtaccaagaagacataccgccttgatcctcatcacccggataaccattttccgagctattatataaccgatccatcacctgacgaatccaatattgcgtcttccaaggctgacccgcgtaactatacaagtaaatcatatgctggatcggttgattaccttgggcgtactgtcccatcttcgccaattccatctccagcatctcatgaattttcgttccgtatgttccatatttcacgataccgggtaaagcgaaaacagagtcgatcttcgccacgaaacgctcatcacctcctgtcaaatcgatcaacccttggacatcatggaaaaccgaccaattgtaatgccaagcattcccctcgcaataaggaccgccccattcgaaagcatcgaaatccgcccaactaccatccaatttacgacctctcataaaaccgacagaaggatcgtacacattcttgtaattatagatctggcgggcaaagacctcctcataaaacttattcccagtcattttcgccaactgatacgcacaaaagtcatcatagcaatattccaacgtctgtgccgtagatcccatggattccggataaggtatatatcccaactgataataatccttccaacgaacccgtccgttggcaccgccccaaggtcccttattcatcgcctcatgcgcatacgctttcaaggctttctccggatcgaaagtgcggatacccttcacccaagcatccgtcaataaagagatcgagtgattcccgaccatcccgccggtctcactcgggaacgaccaagaaggcaaccagccacattgctcctgagcgtctagcaaggcttgcatatattgcccctgcatcgtagggtgcaagatattggtcagcgggaactgggaacggaaagtgtcccaaaaaccattatcggtaaacatatatccatcatgaatcttctcatcgtacggactatagtagtaaggagaaccatcctctttctcctcataaaacttatgggaaaacaaattggcacggaacatgcaggagtagaaggttttcatatcctcctcgcttccaccatccaccaacacacgattcaatagctggttccatacgtcagcagccgcttgcttcgtcacttctaccgatgagtgcttacctagctcacgagtcatcgtaacctccgcttgttccggactgatataagaggtagataccttggcctgtaccttagagcctttcgcgaattgtacataggcaccgattccttccccttcccggctcaaattattcttctggatcgtattcttacgattctcccatgtaccatagctaacgaaaggcttatcaaattgaatgataaaataattcttatgtgtcttcggagagaaagccccattgtgtacatagccggtgatccggtggttcgctacatcgatttgtacctgactggttttcgtatagccatccagtacgagaaaagcgtctcccttcgcgggaaaggaaaaacggaaatgagcggaacgggtagttggagagaactccgtggtaataccattctccaacgtaaccttataataatgaggcttggcaatttccttatcatgagagaacggagtcgcccgtttggactcatcaacaaccaattccgatacaggcatcaaagagaataccccgtaatctcccacccaagggctacattgatgcgtcggttggaaaccccggatcgtagtggccgagtattggtatttccaaccatcaccattcttcccggtctgtggagaccagctattcatgggatagggaaccgccgtagtcgggtaggtatttccccaactcaattcgtaagtcgagtttgttccttgcaaagtatttacgtattgtaccaagtctttctccgcaaaaacagggaaagagagggttaaacagagggctaaagccgccccctgtttataaaaagtattgagtttcatgttattttatttactgattaattattcacgccccaatttgtattcggctcggggcccatctccaattctagtacgccacctttcataatatccttataatcaagatagcatctcgtataatccatcccgtttaatttagcggattggatataggtgttttccggggtatttcggttggctcgtatgataaatgtattcccttcaccaacctggatctcggtcttctcaaaaaccgggctggatatctcatagcgagtatctcccggacaaaccggatacaaaccacatgccgccaatacataccaagcggacatctgaccgacatcctcgtttccaaccaagccttctaccttattcttatacgccttatcgcaaatgaaacgagaccatttctgggttttccacggctgtcccaaatgattgtacaagaaaggcacatgatgaaccggctcgttcgcatgattgtaataagcgttccacaggaaatccgtaggcgtcttgtcgaacatcgtatccagatcggcgatcacccgttccgttcctcccatcagttccaccatacccggaatatcgtgaggcacgaaccatccctgttgcagctcattgcattccatacagccgtaccattccttcagcttaccctcttccggccaagcctcaaaccggccattcgcatctctcgggcggaagctatgtttctccgcatcatataaattccggtaagactgagccaacttcgcataataaaccgcatcctcctgttttcctaatgatttcgccaactgagacatacaccattccgtatacgcatactccaaggttttggagatactctgcggattcggggtatagcccaactccgcattcccgaacattctcgaggttttatccgcataccgataagccttttccatatccaagctacaaatacctttcgcataggcatccgccaagaccgatatagccggatttcctaacatacaaccgctataggcgttcaacaactcccatcgctcatagtactcacgaccactctcctctgccatcgttgtcaatgacttcaacaaatcattcaccaataccggattaataatcgtttgcaaaggcatctgactacggaacacgtcccaaccgctaaagatcgtacgtttcgtgaacgtatccgacttatgcgcttttccgtccgcgcccatatattggccatccacatccgtgtaaatcctcggatcgatcattgtatgatacaaggaggtatagaagatcaccttctgctcatccgtcccaccgctgacatccatcttagccaaagccgtatcccataacgaacgggcacgagaacgtaccgcatcaaaatcccaatccttgatctccgctttcaagttcttttccgcaccctccaagcttacaaaggaaataccagccttgaaaagaacctcctcattcgcctcggtctcaaactccgtaaagaacccgaggtgctcaccctcatatgcctttggtctctccgaaatcttcgcgttcgctgtcaatgtctggaaagccgggctctccacgaattcccgatgccgatcctgccctgccgggatatccacgctccatacaccataatctttcaacggtttggagaactgcgcataaaaatacacggtataccgggaagaaccctcaccattcccccagcctccgccttccggcgtacattccattcgtccggcgatcgtatggtcatctatcacttgaaccgcctgatacgtagaagtacctcctacacgacgggctaagtccaactggatgcgggactgcttattctcggggaaaacgaatctcagcataccgctatgaggagccgctgtcgcctccgcttgtatctggtaatcgcttagcaataccttataatatccagccttggcctcctcggaagatttatcataccgggaacgatacccggttacgcccccctcttttcctgagttcgtgcgcagatcgcccacggtaggcattaccaataaattacccagatcaccataccagccgataccactcatctgcgtaaaggcgaatccctcgatcgtctcatgctcgtagctatatccggaaccattgtcgccccccgtaatcgtattcggacttacctgtaccataccgaaaggggtagtcgcaccggggaaggtcttccccaagccatggtaagcaccggccgcctccgtattcgtactcgccccgataaagggatttacataatcagagaaatgaacctcctcgatagtccgggtcggaccggaacaggcagttcccaccaacgcaagcgataacgccgtggtcgttatccatcttaaatttcttactagtcgtatcatttttttataagttctattctacgtaccttcggttgggcgatctgatacatacgatccaccaacatatcgatttgttggctccaagcctcccggatctccggatacatcatcttggagtagttatccagatggccggctaagaagatattcgtatgaaggttcgcccttaacgtatccatagcggcgatattatcctgaaataacatgcccttccgcttcaagatataaaattccgtccacgcatattcccggaaacgtttctcgatattccaacgttcctcattcaaatgcatgacccgaacggcctgctgatattgcggtgtgttcgttaacgccgctaagttaataccttttgccaaatcctcggccgaaaacgtagaaattgaatccccgtctatctccaacctatacgaacctttcaatccatccacccgcaatacctcttgattaagatcctccataatcggagcgtacaaggtcgcctcatattgcgtatgcttcttctcccaaccccgagagatcgtatccatcggataaggtaaagacttcgctaaataggtaaaagagatcgtacccttgtctgatactttcaattcattcacgaaacaattctcgttcgccaacaccatacgtcgggaagcatcgatatcaactttggcgaccggtttacccgccaatccctgagacttcaagaagaaataggccatcaacatattaccgtggttatccggatgaatccgatctccttgcattaaggtaaaccgcggatctttcgcttgttgtaccctgttcacctccaataccgggttgtggaaatccacgaacgcccagtcattcttcacggccgcctctctttgcagacggatgattttctggatcgtagcgttctttccaagaaaaggcttatttttctcattttgccaagtctcgtcgtacggcgtgccagcgatcatgatcacccttgtatctttgtgagatttcatgatcttctgcatcgcctgaaaggtcgtatctacccgatacatttgccgctccacgaaagccgtaggattatcgtcgttatattcgaaataaccactatcgttcataccgaaagtagccgtaaccaccgtcggatttttaccatatacatcctcctcgatccgttccaacatatcccaagaactgtcaccaccggtaccggcgctatacatccgcatccgcatatccgggaaatgagtgatatagtacaaccatatataagaatgataatgtccgccctctgttatgctattgcctaaaaaaacaacccggtcacccctttgaaaaggggaaggagttttctgcgcattgccacacacaaacacagaaagcatacacgccaaactaaaaagccatcgattagttctcatcttatttacttttggacacttagaagttcaattgtttatccgatacggccacagccacgaatgaatcagcacagccataatacagataccatttattccggtaatagaccagaccttccacgaatacggtacccgcagggtattgaccgcttttttcaaaatcatccgtcggttgcaagaaaggcttatccaaacgaccgatcaattttgtcgggttatttacatcgaacaatgcttgtccggcacaataagagttcgcaggataagcggtatcccctttttctcccggttcgtttttaccattatacaacagaacgatgccatcctttgtcaagatagcgggaggtccacattcggtcaactgactatcgaaatagccggaacggggagagaacaatttaagcaactcaccattctcgtccaacagtgggtcccaatctattaaattatcggaggtagccgcatatacattcttctccccccagtacatgaaatacttgccattcactttcgcaatgacctgcttatctccctttaaagtcgtgactagcgatgcggatttagtcgcctcatccttgaatttgccattataggctttctcaaaagccggaccgaacttcgtccagtgtttcaaatcctttgaggtcgccaccgccagacgaggcaccttgcggttccattgcgtatatagcaagacatacgtaccatcctcggtcatagcgatacgaggatcttccgtacctccgggacattcgttctccgcttgattatctttagccggataaaaagcaggcttcgtatccctctcgaaatggataccgtcagtagaggtcgcatatcccaaacgggaagtccgggaaccgattccctgagcggagttatcttccgcacggtacatcaccacgatcttcccatcataaatcgtagccgccggattaaatgtgtcactctcctcccatgctacagaatcttcccgcatcgggcaataaaacttagttggtaacggcttaattaccggattcactcctgtcggacgctcaaacccgtccaagcaccaagctgtttccgatatagtttccgatacagcttccgccgtctggtctttcttttgagagccgcaagctacggtaaccaatcccaataagccgaaagtagagactaataatgtttctttaatcatgttattcgtagtattaagttatatttattttccatatgaagggggagctatccgagttccccacgtcttatccggcttcccggataatttatattccaaggtcgccccccgatataaatccgaccaatcaatccaagtgccctccatcttctttccatcaagacttaaggaatggatatactcttttttctcatcaccccctttgataatcacgtctccctcgggcaaatgtaaaacaatcttacggaataccggactattcacagagaaacctcccactccgggaatctctggaaacaaaccgatactggcaaagacataccatgctcccatcgatcctaaatcgtcgttgcccggcaaaccgttcacacggctactatattgttcgttcagtatacgccggatcacttgttgcgccttataaggagcccccgcccaattataaatccaagggatttggaaactaggctcgttaccggaggcgaaccattcatctccataactagcgtccaaacgtcggaacatctcatccaaacgcttctccgccgcttcctttcctcctatactatcgatcaacccttgcaaatcataaggtaccatccagaaataattcttatatgtcgattcccgccaatccgcgtcataacgtttccacgagccatcctcgtttcgggactgcaaccaaccggtctccttattaaaaagattcttccagttcatcgcccgttgcgtataccaattacaaaccggctcatcattgcaggcttgcaaggcaaaacggccaatcgcaaaatcagaagatgtatattccagtaagatcgaagcgtcgtaataccctttctccaaatactgttccaagcccggtcgagtcaaaacaccttgggaattagcccccggcacttctgctccataacgcatagtccgcagtaaagttcgaggatcatagttgcgagctccaaacgcatacgcattggctacaagaatcggagtcgggtccccctgcataacacctgtctctatattcgccagtacccaacgagggaagccaccaccggattgctcggcaaataagtaatgagacataacgatatccgaggtctcctcgggagctagcatagcgatcaaagcagtctgcgtacgatacgtatcccaattactgaaagaggtatagaattttcgggctgtcttatgcacttggctatccgcccccatatattccccattcacgtcgctacaaacattcggatggattaatgaacgatatagatgcgtatagaattgtatctggcgatcctcgttatctccctctacctctatcttcccgaggtattcattccatttatcctgcgtcgcctgacggaccgcagagaagtcccaagcgggattctcaaccctcaaattctcacgggcattctccaccgagacataagaaacaccgatcttatactgcaccgcctgattcccctctttcaacggaaaagtaaaatacacccccgagtgactgccttccgcaaacgtatgattcgcatgtagtcgctcctccttccatgtaccaaaactctccgcgtccgcatcgaactcagccacaaagtaaaccttatagggagttgggattccacagaaagcaccaccctccgcatatccctcgcaactatgaggacccgtaatcttaatagcggctacttggataggggtagcggctactcctcctccgataatcacggtaccctgcttttccttggaagaaaacgtataacgagccatacccgtacgttccgtaacggttaattccgcacgtatagaatgatctacggtcgctgcgtaataaccggccgttccgatctccttgccgaccggagtctgcatattcaagatactatccggagaaacccgtaaagctccggcaaccggaagcgtagggaaatttcccatatgatcgcatcccgcaccactcaattgattgataacaaagcctagttgtttcgtgaaataagtcggggtaaactgtaccataccgaagggataggtagcccccggatacaaatatccggaagcccacccattaccttgagtccctatcagggtattggtcttagaaacgagatttgacgcatttaccaaacctccacacaacaagaaaacatagctaaccacacatattcgccttaaaagctgtttacatttaaacatggtaatagatcctttttattatttagccttttatactatatacccttcaatagaataaaacacttacggcgtaataattaaaaaacagctattaacataagtcaacaaaaagggaatcatatgattcctattccgcaaacagcgatagggtgtgttttccactttccaacaagatcgaacccgccgatatttctacattattcccatctaacacacaattcgatacgttaaatggagcgataaaggtcgccgtactattcgctggtatctccagatcaagggaaagcgatcggttctccattgtccaagacacacatgccgtaccgtaaggggtctctctcgccaccctcgcccacgtcacgccatccggcacttgcggtttgataaagaaatgtttatagcccggcctatcctcatccggcaagatccctccgatcgcctgacagaaccaagcgccaatgccattgaaacaattatgaaccttactacgttctcccgaccagtattcccaagtcgtagaagccccttgatcgatcatatatagatatcccggttgctctctctttttcagcatggaatagagaaaatcagcctctccgttctttatcgcccaatcggtcaagatcgtaacacccaccaaaccggaaccgatatggcccttacaattctccaaagtctctcgatataaaccttcctttacctcgggcatatgctgttcatctgtcacgccgaccaacatcggataaatccgatcgatctgggagcctgtagcgtactgtttcttctccggatcatagaaagtcttctggataagctcgttcaatcgttggcgacgctctttatacttagcggcatcctccgctttccccaataccttcgcgatcttctccatcgtagtgaggcaatcgcttataaagcagttgctaaccagatctaccgatgactgcgccgtataatcgacacccgccggagccaaccaatcccctaaataccatgcccgataatccgtatccggccaacgtttcagcaacccatcgaccgtatacgcatccacataacgcaaccaatgtcgcataaccggataatatcgctcgatcagacggctatccccataattcaaataaatctgccacgatcccgtgataataaaaccacaccaatacggaccacctcccgccgggtatggattcggtacgcaatgcggcatgcccccatcctcacggatgcaatcctgccacatctgcatccagttcatatacacggaagagccctcatacaatgtctggaaactcttacaagaggcatttccatccccaccgtatcccatacgctcataatgcgggcagtctacgatataaccactgaaagctaggttcttgaaagtatatttgatcatcgcgtagatagcattcaagtccggatccgagcactcgaaagacgaggcatccttataatccgtatgaatcagatagccagttacctcctcgggagctttcgccaaaccggatatccttatatattgaaacgcatggtggttaaatttatttcggaatacctctttgccttgtccggaaccgatataccaatcctcatactgtccgttctcctcttgtggcttgaaatcttcgttttcatttaaccaatccgtatattccatacggacccggtggccttccggtaattttgggaaactcagctcaacccaaccatttaacgcctttcccatatctacgagccaaatactgtcccctatttgtttgattcctttgggacggatgatctcttgtattcgattaggctcacacatctggggacttacctctatcccgggtacctccacctccaacaccggcttccaatccagtttgtcgagcgtagccgttgtcaaatccggcaacgccttccgcccatccacacattcacccccgaattgatggggataccaagtaccggtaccggtctcaccatacatacttccccggccttcccaagagctatccgtaacgagtagcgtacttgtagtgccatttctttgaatctcgtccaattgcagtttaaccaacggcccatcatgaacggcattaaaagtagcttttctgtaccaaccacggcccaaccagacccataaatcgtttgtcccctgtttcgcatacgacgtaagatcatacgtcacggacaaggatcttttgtttagttgagacaccgcaggcgaaagaacatcttctgataccttcttcccatttaaatagatctcatgataccctaaggagtttacatgaaggagtaatgtggcatcacggtcttgaagctcgaacttcttccttaacatcggattcttctcatccggcatccctatatatttcccttgccattccgctttatccaaaagcccgatcccaaagcgattgattggactccaatccgaggattcccccttatcgccccatacccgaactttccaataggccagcacactagatcgcaactcttttcctcgataagggaccatcacggaagcggacgattccaccttacctgaattccatagatcggctttgccttgagccagcaaggaactatccgtggctacttgtatctcaaaatacgcttgccgcatagtttgcccgtctgtctcgattttccagctaaaatggggatgggtattgtcgattgcgaccggattctccaagttctcacaacgaagatcttttaagatgatcctccgcccggattcacagcccgacatcagtaacaatagggtcacaaagtagatagatatacatttcatgataaatagattgagattacgcatgaatatactttctaatggcttacgatacttatatccccggtaaatattaagatttattaaacaagaaaggcgagccactcgcaaatgactcgccttcctatgattcctcaagaatggctagaagcggatcttgtaggattggttttcgatacggatgatataggaaccttgcgggatggttatcattgtctcaccaacaggtaaggttatcgccttatacaattgaccgccgaatgtcactagataagccgtacccgcatgagcggaccggatatgcaataccccgttcgatccccagactttcaaggcattggattctacctcggcgttgccaacggtgacgttttttacgatcccggtaatagatattgttatatcagagttgatattcttgatctcatacttgccatcagaggtcggctcgatcagcttatcgcctacttttaccataggggtagattgatcgtagtccgtatcgagcgtaagagagaaggagaagctaccgcccgcttccacggaataagttccagcggaaggattcaacgaggcaccttcaacggatggaagggtcacactaaaggtcactgttggatccggtgtggaagaggcaatgcttacctctgaataagcggtcagagtagaatttacagcatttaccgtattcgagacaagacaacgatacttcccggcctcggagacctccagttgcgcatcttcattcgtacttaagacatccgagcgaagagaggagagagccttcgtccgctgtacttccggcttcacttgcttccagctattattctcgctgtcaaatttctcccatatataggaaagattcgcctcttcctcagccgacgcttcgacttttagaagcgtggagaaacccatctctatcctaggcgctttctccggtcgttgggcaatagtaaggccagcaggccccgttacggcatctaacagaccggtttcatcaatgaagataccctcattttccaccaacgcatccaacagggtattttcgccgggtagtaaccgtgtgcttccttggttcaatactttccctaagttattattgccatccaacgtgatctcgatattggatgtctcggcaacggtaacactctgtgacgtagaacttccggaaccaacaatcaagcttttaaacgtgatgccggtaacctttccatcctcagtatctattttcaaggatttaactcttgttaattcctcgtcgtttccgatgactccattgaacttactgcctgtcgtactgccgtccgtataggtagaatcttttccgattgtaatatcagtgtccttatctggcaataaggctcctatcgctttggctttgatagtcaagttcccttttaccgtagcgatagtgaccttgcctgtttttgcgtcatactcgcaaggctccagacctgtaggataccatacctcgatcgagtccggcaaaaaactaccgctatccggaactaaaatgaaagacacggacctcccggatatagctatttccggttggaagggctttacggtaagtcctgtcaactcaaagtccacatcgaaatatttatcaccttcttccaagatataaggaaaacctagccaatcccaagtagcggtatgataagcggcaagggcccctttgggcacgtagattctacatttgtttttatccaagatattgaatgagccattaacggttgaaggtggcgtagaacgttgaatgtgaatctcgtcagcttgtgcgtcaaggaaactctctgttcctacttcctccacactactcgggatcattatggattccatgatacgaccgctgaacgccttaggccctataccggtaacagtataattattcccttcatattccaaagaagaggggattacgtacgatctacctttcgtataggcatcctcttttacacccgcaacctcgacagccgcatccctagtaatccgataggtaaggtcaccaaggacaaaaggatccccactaattttcctagctttcgcagtgatcgtcacgtcgccggtaacggtttctatagtcaaggtatccttaccgaatgtaccatagaagaattccttcgacataggatccagtttcttgcctcccatggtgacggtgatgtctcctatgcctaatacatagccactctcgggcgtgagtctcgcttccagtcgggagccatcaaccaccaagtcggggccataataagcgactccctcaaatccggtacgggtgatggagtatgtgccctcctcccttatgttcttaaagtccttccagacataggcggctttgtaggcagcggaagccccggcaggtacaaagatgacacatgcgtctttatccactccttcaaaagcgtcctcatcagaaatatttctgggttcaggacttatacaatgaatctcttttaaggcggtacacccagagaatgctctccgatcaataccagtgtttccttctagagtaagcttttcgagtgaggtttgatttttaaacgcatcagccacgatatattctaccttataagaattagacccgacagtcaccacttccggtatggtcacttctttctggggagtatctaggaagccatgacaaaatgcgtttacttgagtagtactcatgctataagaaattccagacaatacattttccgtatgagtagagacttgtataacgacatctttattcacttcctcacccgggatagttattacgctaggttcaaaagatttaaatccgggttccagcgtaatattcacggtcaaggattgccctcgagctattgaatccggcgcatcagtagacgctactccataacccacaacataaaccggatatttcttgggaagcggctcctccaaaatttccttaaactgattccaaggggtactggcggcataatcagccttactgccagccggtacgtaaagcgtgattccactcaaatctttctctccgaaagcgccctccattatatggtaatttttggggtctatagctttcgcatgaatctcagtcaaaccagcctgtatggaaaacgcatatggattgataaaatacttgttgttcggcaatgttattgatgttatattagcatatctattataggcaccggaataactattcaaactatagtgctttccttttgcggttaccacgctctttaatactatgcttgatgaagtcggttgagtttgtgaaggaggaagcatagcgctgcattcctcaagcatatacctctcctctccaatcattatttccgtatgctcaacaacctcaattaagatcgttccagtaatattcttcgccacattagcattttgggaatcatcccatgagaaatccctaaaattcttccctgcttgtgatatagcaagacgataagcacctgttgatgttgctattttaaaagtaaaactacctccatcctcaacctctgacggacaatcaatcgtgacattaccataagtattagtatatatcttgtgcatcactttcgtattttcctgcccccaagcaagatacacaccacacaaaagggctatcaccaccagcgacagccgtaaaccgattcgtagtaaatttgttttcataagcgatataatttaaagtgaataatagtcttaacattcgttcacgggtatgctcatagcttcccgtttatgaccggtgagagagcctaggccatgaaccatgagagagcctcgtctatgaggggtgagagcctaggctttatcagccctcatagatgaggctctctgccttatcagatctcgtccgggctttcgctatcgcctccgcctccggcacctaccgtcaggaggatggggaacttataggtacggggatccttcaccaagccgtaattcgcccccgcctgcgtagtgacgctcagccagtactgcccctcggcgagttgcgggatctggataattatctcgctcttggtgttacgtacgataagggagactttcgttggcgtggcgccctcctcgtccttggtgaagtagacgcctacagatggatcatcccccttgataagcagcgtgctgccgaagatgatagccggggcgttcggagtgatatggaggttcttctcgttcgtggtggaatccgtgaggctctcgatcatcgggcccacggtagctacgtcggcgttcacgtagatgttttctagcgccttcaggagggtggcgctgggggtgaacattacggtgatcttattctccgtagagcggaagtctgatttctttccgtcgaacgagccgttgatagtgagcagccattgcccgaacttgttcaccacgcaacggccttgggcgagggcctcgatcatctcgtcgtaggagaggtcgaggatgttggtgatcgtctccgggcggtactcggtgcgtttcttcacgatgcggttcgagatgtctgacgttcgcgtggttccggtaatgcggatctttccggtgaaatcgccggttttctcggttaacacgttgtcgtacagatctacggtcaagatggtcttttcttctgccatgatgttttttgtctttaatgccccgtggtagtggggcgttaccttttaataatgtttatcacccttattcgcgaaataaggggaggagatatcgcacgtccaacataaactaaaaaaacgcataaccactatttttaaccgcatatccacgatatatgcgcaataagcataaatttggattagttagaggatacgatgcctgtatccccttcaattcctatttcttaataaatagataaaagtgattgtttatcaataatattttttacatttgccaagccttctgttgaaaatagcctattataggtaatttttatgctgagtaggctattccccttatttcgcgaataagggcatcacccagccgccaaaagcaaatccacctcttccgtcaccctagcgttcgcacgattcaattccgactgttccaaagaggccagataaaaacgtgttgttttttccgaggtatgccccaacgcttggctaatgatcgataaagggacttgtttccgcaaggcgttcgttgcccatgtatggcggaaaacatacgaggtcagatgaatggggcgagatagcgcacgaccgatcttcttcaacgagttattatacgaacgcagtatcgccttgtattcctcatgccctacctctctacccggagataaaatagggaaaaggtacggggaagaagcgtccgcatacttattaatcaaccgccgcatccccgctgttatcccgacacggattaaggtccccgtcttcttacgccgatatacgatctcctcgccatacaggttcgccgtagtcaagcgagccatatccgcgaaaggcatgccgcaagataaataggcgaacgtacaatagtcgatcacgcacgccaaatccggctcctcagacttcaaggtcacgatctcccggagcgactcgtttcccaacgccctagatccggctctttcccgcttcaagttcaagtacgcgaaaggcgatacgacgcaagccggcaacagaccatcccgacaagcttggttataaatcgagcgaaagttgctgaggtatgtattcacggtattcactcgcaagccggcggattgcagataagcgacaaaacggcttattaagcccggggttatctccgggaaaagaaggtttctcctacccagaaaggcgcagatccaattacgggtcgtcctatataaatcggcagtgttatgtttccccgctaaacgtttctcccggatacgttcggtggcataggtataaaatgtgatgcccgccttgcccaagcggttattctttcttttgctcatatctccttttttgatgattaaacgtattattatctaccatcaaaaatagcataaaaacaagatcaagccaagtccatctcgcaaacagcaagcttccaacccttaaagaccaaggtgacaaggcgaagctccgtatcccccttggtagcgtgaaccttcgggtcagcggcgtaacggcgtaactggatggcggcctcggctctcaacgcctcgatttccgtttcggaagcgtcccgacgggcgtatttcacctccacgatatagctaaagcctatctcgggctggtggatcaagtcgggcatcatgtagaaatcggcgtaccccttgttggcctcatactccggataaattatataggtacgggtcaagcctagataagccagtaggaaacctttcacgtgcgcttccccctcaatgaactcacggatagcgctctgccgctccagctcggaggagaaatactcgaacacaggcttccagtctccatcgtaagccatgtcctttaccagatcatgaagcttatataactctattgagaagacatcagcttccttatacgcctcgatcagataggtatataattgctcacgtaccgttaggttgggaacgcccagaagggtatctccacgcttggtacccttgatggagagcaacccgaaataataaagcaggctcttgaagttatcgggcttggtaatatcctcggcgggaaaagcatccttgataaccgcagtggtctcgccgttgttcacgatctcctgtatgatcgaggcgttcgtaccgaagcgcttgtcgagacggatcaaatggcggagcttgttgtagtcggtacggatattgttgtcgatcatattcttaggaggcttgtgaagactcagataattgctcaggaaatataataccatatccgagttgtacatcggctcgtccatacattcttccgagaagcagtagttatcgtaccacggcttcatcaagttgatcagatcgtccacactatcctcgaaacctgtctcgctcttgtaataggccagcatctcccatacctctccctcgctaaaacctatgattccgttaaagcggtaatccgtcgtcatgttggctccgatattgaaaccgctggtcacgtcgtccatcgtcaccggagacaccccggtgataaacatgcgcttgatagggccatcgcccgtagccccttctttcagcttgttaaagaaataacggaagaagcccgtgccgtgcgtcaatgccttgtaatgcttctcacccatattggcgaggatagcgttggtgaagttatcatactcgtcgatgaagagatagatagagagattcaagcgtttagcctcactgatcgtgtaggtcaacttctcgtcagcatttggcagactctccattttctcccggaagcccggattgaagaaacgttcgtagtagtaggcaaactcccggaaacgagcggcacagtgatcattaaaagagcggatcaactcgtcaggatctgggttcacgcctgcgaaattgaaatccagtacaagatattgtccctgctccggggtcggatgggagccgatatataagtcgccgaagagttcctcaaaagaatccttacggttcacgtcataataccatctgaggacattcaagaatagcgacttcccgaaacggcgcgggcggataaggaaaaagaaacttgcgttccgctccacctccgcaatatagcgagtcttatcaacataataataattggcggtacggattcgctcgaaatccgtcaggccatatggaatttgcttcgttgccataatatatctcctcctgtttatttgtcacttacgaataaatcacttgttcgtaacttacttacgcaaagataacatctacaaaatgatttcacgaatctttatatattaatgttatccggcctaaaggagaaagaagactgtctaacgttaagaccaccaattttctcaagttatgggcgagaaccttcatcccagacaccgcaagcattctgaagatcatcatgttatacaaagcatgccccgaaagggaaactgttttgacaatgcgacggcagagaacttcttcggcatcatgaagtctgaacttctttatgcagaagaatttgaatcgcccgaagccttcatgaaggctttagaggtatatattgaattacaacaataaaagaataaagtcccggttaaatggaaagagtccagtacaataccgaactctttctataattggtaaaggtttaacctgtccaactttttggggtcacttcattcggagatagcctctattttggcatctgagcctttcacatcttaacaaaaaatttctttttaatcctaattagaaaattcattgcataatacaaactccgcaggaacatcttcttctataatcgtaaatcggcccaattcttcataaaaacgattatcattaatatcatcatttactgtagaaacttcgcctaccaaacaatgcccattttcagaccaaaatgtatgatatagataaggctcaaaacagatactctgccccggcattaatcgcaaagtttcaccagctttaattttcgtcctaacaccatctatacttacacagcaatcttctgtagataatccttccgtcgccgtcgctttccataagcgcatacacaatatagcacgccccctattaataatatcctccatttttttccaatggaagtgaacaggggtaacctgtccttcacgaaccatcatgattttttcacagtaactttttttgtcacgatgaatattcccattacgaattgtaaccagcgtaagcccctcctccaaaaatcgtcctttcccgaagtctgtcacatcccatcctaaatgatttaaacgaatctcgtcataagctttacctttcttttcccatatcgcaggactccataatatccattccggcaaataaaaatggctttcttcaaaaaactcgatagcctcatgtataaattggtttatttcacttcttctcatatcttatttacttttataaaatcataaacttcttttaatctaggtgccccaccacaacaagtcgcatgtaataaattaaaatgcgccaaagcatttgcaaaccgcagtgtatcttttaatcccagaccttcatgtgccgcatatagtactcctgcacaaaaggcatctcctgctccaaccgtagaaacaatttcatttgattgtatcttataggatgggcaaaagccttcctcaccagaacgatgtaaggcatatcctccttctggaaaatgaatacaacacaacgtattcactcctgctttcatcaaatctaccgctacaagccttacctgatccaacagaatttccccattatcaccacgtaaagatatcccatagcatgatcctgcctccacctcattaattactaaataattaatatatggtaaacaaggcaataagacattccgaaaacgatcactctcttccgagactacatccacggaagtctcatagcctttttgctgcaattcatgaaaaacacgggctactttcaattgatagaatttatccggttcctccaacttatccaataacaatagatatcctaaatgaaaaatcttagcaggaacatctatttgatctatatattctataccaaactctgcgttcgctcctcgattatgaaaaaacgtacgggttgtacccgctttagccaccataacatctgtataagatgtaggaacactggataactgacataaatatttcgcatttatcctttgttccatgactgttttcaagatcaagtccccatacgcatcttttcctatacaaccagcagcatacaaaggcaatccactctgcaattttgccaaatccatcaaaacattgtgagcgcatcctcctaatccaacttcttctttttcgatagagaccaaatttcccggagcaggataataaggaataaatttgatcaaatcggccagccatgtcccagctgcaataatccccgtcctcattgctttactttattattactctcaaacagtttgatatgatctgctacagcattctttgacgcacactttattttttcttttaatccaatgtaccccaaatcagtctcatttttcatgcactcacgtaactcatccattatacgtaattgaatagcagtcgctacatttaccttactaatcccattatgaacacaatccttaaagtcagcctcactagtacccgatcctccatgtagaactaaaggaattggattccggtctttgatctcttttagtcgttggatattcaagttaggtgtagctgtatatttcccatgtaaattacctatagaaatagcaagggcatcaatgcctgtttcttgtacaaatcggattgattcatctacatctgtaaacgtattcacattattatcccattccaccgtatcagtatcaccaactttccctaattcagattcaactgctacaccaaaagccttggccatttggactacttcacgagtaactcggatattctcttctaaaggtagggtagaaccatcaatcatgacagatgtaacccctaagcgaatcgcctgcgcacaagtattgaaacttaatccatggtctagatgaacagcgacgggaacaaaggagctgcgagccgcatccacaaacataggtatcatcttctctaatggcgcacaagggaactgtacttccgctagttgtaaaataataggagagttcaattcctccgcagccattatcgctccttccacattttctaaacttaagcaattaaatgctccaacagcataaccattttgataagcatctgctacaatttctctcaatgaaactaacataaacaatattttttgtacaaagaatcaatcaacaaattcactagaaggaggggttgccccttcacctattccccagcccttattaggacggttgcccattaacagttccaatgttccaccttccatgatattctcatgggtaaaccaagtcttatcatactctactccattcaatttagcggactggatgtatttattttcccaagaagctccatgagcaatcaccgtaaacacttttccattcgccaaccgaatctctgatctctcaaacaaagggctacctatcgtataaactggcacacccggagataccggataaaaacctaatgcggaaaaaacatagaaggcagacatccccccaccatcttcatcgccgcagatccccatcaaatcattccggaaccaactttccataagcatacggatccgtttttgcgtcttccatggctgacccgcataattatataaataaggaatatggaaactgggctcattacccatgacaaattgccccacattaccggtagcatcaggatgcacggcataatactgccatttagatcgcttcatgctttctacaaataattgatctaatttttccgtgaaaggttcctcccctccaaataaatcaattagatcttgaatatggtgatgtacatcccagttatatgtccaagcattattctcatcataataagctcgagaaccaatacctcctgaaaaaatatagtcaaatggttctataaaattcccatccttgtcttttggatgaaaaaagttcgtctccttattaaagacttttcggtaattgtaagaacgtttattgaagaaatcatactctgtctctttttttagatatttggccaactgagcaatgcaccaatcatcgtaagatgccgcagtagtaaccgcaacagcctgccgctgctcaaaagggccaaccattgggaaaacctccttttctcccggatgtaaggctgggaaccaaccatgctcatgatagaaatcatccaactctgtcttaggtcccaaataccatgggatcatggattcattcattaccgtatgcctcattccctcaaatgccttctccacatcaaactgcaatcctttatgtaacgcatccgcaaaaacacctgctacatgatttccattcatgcaatgagcgtcgccaaacacacatgggaaagttggcatccagcccgattgctcatacatgcgaatgtaggaggaaagcttctgttcctgagctttcgggtttaacagaacttgtaatggatgaagcgcaagataagtatcccatacccaatcatctacccaaaaatccactcctccgtcctcatggactttcccatcatatccactaaagtactttccatcctccgaaatattaatcatcctttcatgcgcccgatataatgacgtataaaaaacggtcttttgatcttctgtgcccccatctatcacaattttagacaaagctttattccattcttgctttgcttggccagcaactcgatccaaatcaaaatcagcaatttcttctctcaaatttttccgggcctgttcgacactaatataagagattccatacctcaccttaatttccttcacggaagaatcaaaagaaatagactttgcgcagatcttttcccaatcaagagaagacacacttaacggatcttgatcaaactccaaataaaagtaatgcttaatcccgttataaatctcatagccgctcaaggctttatttgcccaaatcaaatcgcctttagcgtttgttctcaatattatttgggggttatcttctttttcaaaagcaaatgaatagatagccgactttttcattggagcaaagcgagcttctatctcgtaatcatccaaaaaaacagagtaaaaataaggtttggatatttcatgatcatacctataatcaaatgccccctttgaaacatccaaattgccacaataaggcataagcaataaaacatcccccctacggtgagaaggcacattcaacggtaacccacgcatccgatctgtaacaaaatcatgatgcccgggaatcatcctaagcatgctattaggctgatgagtcgtaggaaaagtaggaacaagcaaatggcttatatttcctatacgggtgttcacatagtctacgggagcgttttctgattgcgcatccaatgcgaacaccccacacgcaaacaaaaaaactctcatccaaaaacacttcgatttattcattttcgcatcaattttaatatttaagacttactgttattctacactttatggtgtatactccacggtgccttttgaattcactgtatatccccattgtttaatataatattctccctccaagaaaggatccccatgctcctttaatgagctgaacagtttttcatccaattgttcttgaagatgcttatagcctacttcatgaaccaaatttctcaattgatacggatcctcttgattatcatataaaagccaagggcctaataaatcccgaacatacgtatacctcctagttcgtacacccctatactcttttcctcctttatctctttcccattccccaaaaggtgcgatacattcgatcaaggccatttccgtaaaatcagtaatttctccccgtaatataggagacaaatctttcccttcaacagactcaggtacagtcacatttgacattccaagcaatgtaggcattatatcaacagaacttaagatcgtttcaacctccttaccttttttcccaaatatagccggatactttaataggaagggaaccattatactctcttcataaggtttttgcttacactccaatccttgagagcctaacatatccccatgatctgacgtgagtacaaatatcgtatcctcctccacccccaaacgtttaatcgcatcttgaagcatacctacacatcgatccaaagccgttatatgcgcataatatccttttaaatcacgagtcgctttctctttcatctgatccgggacattcggacgaagagttatgtccttatctttatataaattcaaaaattcttccggtacaacctcataagggctatgaggtggtccccaagacaggaacaagacaaatggcttttccccattagcatgctcttccatgtaatgtaccgcctcttctgtttgtgcaaaagcatcataccctttccaatattttttttccggattattattgtcataataagcagaatgcatataattatgcgtacactccaagaccttgaagaaatcaaaaccctgcctatgtgtctcaggaatataattacttcttccattcccatttacatgccatttccctatatatcctgtatcgtaaccagcgtttttatatacctttcctatagaaaccgaatcaggatccaaggttacatcattcaaaaacagtccatgcgtatgggcatattgccctgttaacaaagagccacgataaggagtagatactggcatgcaagacaccgtatgcttaaataccaaactctcactagccaatttatctatattttcagtaataacatcgttatttcccgcaaatcctgcatcttgggcacgccactgatccgcgaagacatataccaaattaggtcttttacctctccgcttatcattcctcgctacagaggtgcaagatcccgacaacaaaaaagtccccgccgccaatgttgcgctctttatgaaatctcttctcgaagtatccatcgtatatcattttatatacctaaacctattcaaaaaactctccatcttgttcaaagtatcataataataaacattattatttctaccatgattaaaaaaaccatgttgctgatcctcatacaagtatagatcacatacatttcctaattccaacatattatccctatatttttccatcgtttccacaggaattaaattatcatttgtccctaagaatattatagttggaggtaatccttcctttatattgtaataaggagaaaattccttataatgcttttttactcgatcataaccatatccttcggggccattatccaacactggattaaacaacaccaacaaattcggcttacagcttacggataaatcatccgtagcgtcattaaaaccatctattgatgcgattgccgctgccaaatgacctccggcagaacctccggaagccactatgctatcactcttgatacacaagctgtccgcattttttcttatataacgaatagcggatttcgcatcagaaagacaaacaaaaggcgataccttatgcctaccctgaaccctatagttaacacgaactgttatcaaccctttcttaacaaaatggtcggcttgaggcttgaaatgagcgatatctccagctatccatcctcctccaaaataaaacacaatcgccggtcgtttttcagaagctttcatatcatccggataatcgatatacaacttcatttgcaatgaatcgactgttttatataccacttctacactccttgcttgcaaggataagcaagtaaataattgcaacattagtatgactattaatatcctcatattcttatttaaaataaacgtcattaatctttttcatctcttcacaactctcatcgtcatcaccatattcttttttcaacctcaataattcaagtttcaatttgtttattaagaactggttctggggatcattataaatattatgcatctcttttggatctttttccaaatcatacagttcccattctggagctatcgtaccatctttggttccgattttcccaagagatcttgcataataataaatcaacttatatcgatccgtacgtattccataatgagctgtcgcattatgagcgccatctccttgcatccaataacgataatacatagactgtcgccattccggagaagcctttcctgataaattatcccgaaaactttttccttgcatataagcaggcgtattcttaacccccgcataatccaagaacaaaggagcaaaatctatatttaagataatatcatcatttattcctcccgcttgaatttctttcggatagcgaatcaaaaacggcatacgaagactttcttcatacatcaaccgtttatcaaaccatccatgttcccctaaaaagaaaccttgatctccagtataaacgactattgtattttccgttaaattgttctcatccaaaaatttcaagattcgaccaacgttctcatctactcccgctacacaacgtaaataatccttaatataaatttgataagcccaatgtctgaattcatccctggacttatccgatggaatcggagttttcaagtcatttttattcatgaactctagccccattcgtatctcagaagtatattttcctttactttcataagcatcgagcaaattagatggctcgggaacattcactccttccaacaaccccttaaagcgttcggcaggttgccaaggtctatgaggagccttaaaatggcacatcaagaaaaatggcttattcttatccacattctccaaataggaaatggcctcatttgttatgacatcggtactatgccccttatgaacttttcctatagccccttccccctctttatttgcgacatcacgccaattccctttttcgatcaatatcggatcatggtatcggccttgccctggaagaactttataataatcaaacccacttggctctgttcctaaatgccacttcccgacaatagcagtctgataaccggcacactgcaactcctttgccacattcggcaaatctctcgagagacgatcacctaatgtatatactccatttttttgactatattgccctgttaaaatagccgccctactaggggtacttatcgaattggttacaaaacaattattcaaacgaacgccttctttggctatccggtctatatggggtgtcggaagtactgatgataatatcccaccataagcactaacagcttgagaggtatgatcatcagacataataaaaatgatattaggagccttattttctgaatgtgcgaaaaaaaagctaacctctacaaaaacgaataaacccgtagaaaatatcttatacatactaacgattaattaaaattcgataaagaataaggatagtcatccttactatattgtttatctctaagaggatcagataccatatcaaatcgtaaagttcctccttgaattatatcctcatgacgaataaataaaggagaatatatatcttcatttaaataggtttgtcccacgaacctgtttttttcgcaatttcccggagcagagataacaaattttttcccattagataaagaaagtgtcaccttatcaaagatagggcttcctaaaatatattccccagaacccggacaaacaggatagaatcctaaggcgctaaacaaataccaagaggatgtctgtccattatcctcatcgccgcaataaccattaggagttgaattatacaaacaatccataattttccgaacccaatattgagttttccaagcctctccaacatatgtgtacaaatagggaagatgttgggccggttgatttccatgagcatattgaccaaatcccgcttgatgcatttccgcaatctcattaaagctacgatcatataagctaaatttgggaggacgtgtaaacacagaatccaatttggagataaaccgcgactttccacccattaaactaaccaaaccttgcacatcatgaaaaacactccaactatattgaatcgcgttaccttccgtataaggaccaccccagcgatacggatcaaatggagaatgccattccccattaagcatgcgcggacgcataaatcctgaaatagagtcataaacatgagaataattcatcgcacgtctcttaaactcaatagcatcatctatttctcctaacaaatccgctaagcgcatcgcacaaaaatcatcataagcatattccaatgtcattgaaacagcctgaggatatttagggtaagggacataacctagcttattataattttcccagccatatctccccataaaagattgtggagcatccatggaacattctttacgaaccgcctccaatgccttttgggcatcaaagtcccggataccttttacgtaagcgtcgctaatcaaagaaaccgcatgggctccaatcattgaattccgataacccggacttatccagttcgggagccatcctccctcctcataaatattaatcaatgcttgcatcaacttccctgtcaactcagggaacaacaaggtataaaaaggatgagctgatcggaaagtatcccaaaagccattgtcgctgaacatgactcctttatgcacttgcccatcataagggctaaaataaacagcttcccctttctcatcatactcataaaactgacgaggatataaagaaactctatacaaatttgaataaaaagtttttttctgttcttcagttccaccttcaacgttaatacgtcccatcaaatctgcccaaaccaatcttgacttttctttaacttgcataaaatccaagtcaccaatttctcgcttcaatgttaactccgcttgttccacggagatatacgatgaggcaacctttacagaaactcgattgcaactattttcaaaacgtaaataagatccaatataagaagactccaactcttttttctgctcataaactccatccttgtcccaaactccacaatcagaaaattcagaatcaaataccattacgaaataattcgcaaaattcgatggtacacctcctgtgttattcttacaaaaaccgactatcttccgttcttccggaattatcttcacatgtcctccttgattaaaagcatccaatattaaaaatcggtccttattatcattaaaagagaatcgcaaatatccacatcgttccgtcgctgtcaattccgcatctacattataatcggccaaatgcactttataataatagggagtagcaaattcatccgaatgataaaaacaagatgagcgttccgtatcttttgttttcaatgaacccgtaacaggcatgatcgagaaagcgccataatcaccaatccaagggcttggcacatgtgtctgcttaaacccccgaatagaatctgactgataagtatatacccaaggatcatccatcagaccagtttgcggtgtccaagcattcatcccccaaggctgcgtaaccgcagggtacgtattgccatgagagaaagctctattcgagtttgtccctattaaagtattaacatagctcaaacctgacaggcttgtatccttttggtttgaaacattaacgcaggatacaaataacaataaaaataaactaacacaatacgaaaaacatctcataatcatcttacttaattatattcaaaatcaatctgcccacaaccccggacgagtctcatacaaggggaacccagtcacacgatcattttggtcacatctgcgacgcatccaccaaggatggtcttttgtctccttttgccaattcaccaaaagcttagccaattttttaccaacgtctcgatactctttcacatccgccacatttgtaaattcttccggatctttttccaaatcataaatttctatcattggacgaggagaagtaaataaaagggcttgctccttgcttaacgttccctctttttgagcgattttcaaatcataccaactcaaacttgagcctaagtccatcgtcgtgccatgaggaagctcataatatgcgttataaataaacttatatctttcggttcgtacgcagcgaatgtattcatctgtatcatgccaattcctttcagcgaaaatgtagtcccgtcctcttttcgtaggatcaaaaagtaattctttaaaacttctaccataaacagtatctggcatattaattcccaccaactccaacaaggtaggagctaaatccaccgaacttaccaagccattgctatgcactgtattcggagtgatatgtttatcccatacaaaaataagaggggtttgaatccccgtatcatacaaggaacctttacagcgggggaaaggacggccattatcgctcatgaacacaatgatcgtattctccagctctcctcttttttccaattctcccagcataatccctatattccgatccatacgggaaatctcatcataataatcagccatatccctcctggtatctgccgcatccaccaaaaacggaggtattttcacatcctccggcttattgacttgaggacaaacttctcgattataaggccggtgaggatcaataaagccaacccataagaaaaagggttgctctttgctatcatccaaaaacttccggtaattacaatacagctcctccgtcaaatctccctgattcggtttatatccccctttaatgacatgggtaaattgcttatcaccattaggcccccaatgcgttttaagcattacccctgttgaatacccggcttgattaaaataatagggcatcattttcgtagacccatccaaagggttgtgcaagtcctcggtgcctatcgtatgggcaaactggccggtcatcatactcgttcttgaagggctggattgaggagaagtaagataagccttctcaaaacgtatcccttcttttgccaaccggtcaatattgggtgtcttaataccattattcccgtagcatccaaaatccatacccgcatcgtccgcaacaaagacaatgatattaggtaaacctttttctgatttttcgctcccataaacaaccgatgagatcataggaaacgaaactaacatccatatttgtttctgaaagtttctcatgatattttatttatagggttgccccatacataggcaaccctgattaattttaatatcccggattctgcaaaagtccaggattaatatctatcgcattcacaggtatcggaaaaagtaatttatctttagtcaagttaaaccctttagagtttattacctccattgctctatttgttcttactaagtcaaaaaagcgatggaattccattgccaattctacacggcgctcatgctctaaagctttattaaaggtattatactccttcggataatcagcatcaccatatccaacaagcccggccctagcacgaacttgatttaagtacttcttaccttcatcttcacccacagcctctgcatacatcaataaaacgtccgcatatctcagtattttaaaattattaccaggatttctccaattaggatcatagaacttcatcgtaaatggataatcttcccattttccactttctaaatcaacgaaaccctcaacaacagtaacatttttacgaatagtatctgtcggttcaaattccgctatcaaatccttcgttggcgtacaatgcccatgtcctcggaatgtttctgtttgcccaggtagatggaaagaccataaaaaaggcatataagcagtctggtgtgtactattcggatttgaaactcctgctaaaaattggcattctaacaatgattctttgcaattctttgtagttggagcaaataaatactcatagtcagtaccatcaactagcccatcctcattcgtatccaatgaatataaaccactgtcaataaccgatttcagttctatagcagctttagtcttatctccaagcgttaagtaaactttccctaaaagagccatagctgcatatttcgtcacttttccaacatgcgttttagaataagattcgggaagatactctttcgccatagtcaaatcagttataatctgttcatatacttttgaaggatcctcccttaaataattataagattcttccggagaaatcggagccaaaggcatcggaatagctccccacgcccttaccatattaaaataaaacaatgctctaatagtacgaacctctcctatgaattgcttttttgttttttcttccttataaacagcctcactgttctctagccaatataatacattattacatatgaatataccattataacaagcattccatgcatctaatatatacccattattatcttcctgtatatatctacttatattatctagaaaaggatcacttgaagcaaaatactgcatccatgtattatcagaatataactctccatataattcacaaatgctagactcttcatacaatctgttcaattgcctataacaatcgtttacagcagcagacaactgatcttctgtcttataaaaattcccttctgaaacttgcgtatttggaaacttactcaaaaagtcatcaccacaagaagtcaccaaagctcccatagctaaaatcaagactatcacttttttcataacatgatccttttaaaattcaacattaattcccattgtaaaaaccttagccgttggatattgattatccgaagtacctcgtcttctagcttctgttgcattatttttaaacgattcaggatctatccctggatattttgttatcgtaaataaattagttccattaacaaagagacgagcaaaaccaatatgcaatttatctgtcaaactcttaggtaaggtataacccaatgtgatatttttaaaacgtatatatgagccatttttcaaccaataagaagacccctgtgtttcaaaatgattcgtatttctatttagtttataatgataaccatctcctggttgctccggagaacgataccgatccaccatttctgccagatagttccgtccttcatgataataagttgaacgaatcatattcatatcataaatcttctgtccatgtgcaccttggatcaagaaacttaagtcaaaattcttatacttaaacgtatttgtcataccccaaataaatttaggagtattttgccccaatgtagtacgatcctctgagtcaatctttccatcattattaacatcttcatattttccatagccaatgccaatacctggatatttagctgctgatgctaactcttcttcattcatgattaccccttgataattgtagccataaaattcatatagaggatgatcgacttgtgtaatcaagcctaattgtccagcattacccgggtaaaacaatataggagcatcatcttctcctaaacttaacactttacttttattcgttgagatgttaaatacagtctgccactggaatttaccgactaaatttcttgtcgttaaatttaattctacacctttattttccagttctcctatatttttaagtactgtctgaaatcccgaagtagccggcaccggaacatttaatagtaacccatcacaataagaacggtaccaatcggcttccagtagaattctattttgtaaaaatcctaaatccacacctatatttaattgttgtagcctctcccattttaaatctggattgcctaatttactaggataataagaagattctatattttctccataaacgattttccctttatccaaatttgctatccaagaatagtctgcaatcccatcatttccagtcacaccatagcttgctctgatttttacagtattcgctattttaaccaatggcttaaaaaaagattcatcagacaatctccaagccccagataccgaagggaaatagccccatttattatttgctccaaaacgtgatgatccatctctacgcaaagaagctgaaagcatatattttccatcaaaggtatatgaagccctaccaaaccaagagactcgggctgtttcaacatcagaatcagcagctgcacttaatgttttacccgcaccaacataatgaatcaagtcattctcataatctgtacgagcagcggttacactttccagcctacgataatttgcctcataaccagctaacgcggaaaccgcatgtttaccaaattctttattatatgtaagtaaattctcacttgtaacataaagtgtcttattccattttttatagccatagcctgcatccatagcgttaggtcccatattatggtctttaggctgatattcatctctatccgaacgatttatataataattaaaagtagttttgaatttcaatccgtcaataatatctagggcaataaacgcatttccataattcttgaatttcttactatataattcccaatcaatacaataaagaggatgcccattacgagccctaaacaacaatgagttatagttctcaaatccctcagtagttgtaggttcacctaaaaggccgtccttaccataaactggataaatagagggatactgaacagcccactccactgtccgactaaaaggttctcgttccttatcatacaatgcggtcatcattcctcctatttgaagccaatccttgatttttgtggacgcttgtaaagacatcgtatatttctgatatgttgaagtgatcacgacaccatcttgtttgacaactcccatagttgctgagaaattagaggttttattcccccatgaataatttaagtcaacttgatgcataggggcattcctatatattacatcctgccaatccgtatcatacaaagtttcgggagagtctaacgccgtaggccaagtatatttatattgattcctacgtgcttctaaagtattaggagcattaggatctccaccatcttcaatccatgcattctggattgcatccttagcagcttcggcatattctgcggaattcatgacatcaaccttttttatcggctgctgtatgctaaacttatatccaaaattaattttacctttaccctcctttccgctttttgtagtgataagaattacaccatttgttcctctagaaccataaatcgcagcagaagccgcatccttcaaaatatcaatagactcaatattactaggaggaatcaagtttaaatcatagtcgggcatttggataccatccaccacaactagtggtgcctgagaagctgtaacagaatttataccacgaatttgaacggtagaagaagctcccggacgacctgtggcagaaacaacctgaacaccagctacacgtccagcaatggcctgtccagcatcaacagctggtgaactaataacattctcatccattttaactgctcctacagcccctgtcaaatctcttttcttcgttacaccataacctaccactacaacttcatccagcacttgggtatcttcttgcaacctaactgacacagctgttttaccagccaaagccacttccttcgtattgaaacctatataagaaaccaaaagaacagcattttccggaacattttgaatagaaaaattcccatcaatatctgttattgttccatttgtagagccctttacaacaacattggctccaataaccggttctccactaggatctaaaacaacacctgttattttattagttttcttggatactgttttctcaatcgctccctctttcttcaagataatattcttcccttggatctcatatatcaatccttggccacgcaatatctgttcgattaccgcattaaccgattgattctcagcagacacagatactttctttcctgtatccacgtccgccgacgaaaatacaaatgagtagccgctcctactcttcagttcatccattgcttgcttcactgttatattactcactttcaatgttatatcctgagcactaacagttagatttaagcaaaacaaagctacagccacataaatggccttttttacaactttcataaatagcttaatttttagtaatttaacttgtgattgatgatgacctttcagaggattgattacatttgtattcctcatccagatcatttgcataatgtaatttgaggatttatgagtcggaggatctagcccattctccgattccttttatatcctgttactccttttttaatctccttccatatactccatatcaaaacaattttaaggttaaacaattatttatcacttcgcataaagtagaatattgtctccttccaccttatactttacttgatttgtagcagttataatatccagtacattatatatagtctgttctttcctattgaacaacgcataaaaacgattatgagttaactgttcatccacgatttgaatctttacaccatagctacggttcaattctttcacgatatcagcaagaggcatttcatcaaagaaaagtccatcatttgtccactccttagcattttttactttggctcggcttataaccatttccccagtaagtttatttaaggtaactttctctgatggaaacaagtaattaattcccatcttctttacataattctctagctgaacttttccttccaacagattcacggttacctcttcgtcctcgtcataattccggaagttgaatttagtacccaatacttttacattcaattctttcgtcattacatcaaaaggtaacttctcatttttcctcacctcaaaataagcctctccattcagtcgaagatggcggtctttcaccccaaaaccttgcgaatatacgatctttgagccagcgtttaaccagaccaatgtgctatccggtaaaatcagcttggtcttggcccctaaaggagcttccaccaagatatccgcaaactggttctgtaattgccgctcaccccaccaataggaaatcgtagaagcgatcaataataggataaccgctgccgcaccataaacgattttaggaatattgaaaaccgtacggcgtttttgctgggtacgagaaacaaaacgatcgaacgccttatcgacattataggcacaggaatcatcggcaaccaaagcagagaaccaaagttcttgttcttcatgatcaggtaatgatcgctcgtttttcgtatgtgatttcttttcttccatatagattaaatatccagcttttatatataagacagttatttctcctcaaggggtagtgagaaacatcaattttttcatcctcacaaggagaaaaatgatatcaacaagatcagatacttcctcagatcttgatgtaggcgggttaaagccatctttatgtggtatttaaccgtattgacagaaattcctagctctgtagcgatttcctcatttttcttatgctcaaaacggcttttcctaaaaactcgtttacattcatcgcctaaactatcgattgattttatgatctccttctctaactcccgttcaagtaatatacctagcggctgttcatccgattgtatcatagcgtcccaccccaaggtctcagactcaatcttcgagaaacggacttccttcttttccttttctgatgagatatggttataacagcggttccgcacagcccgcattagataagcacgaagagagctatttatatccaatgtctcacggatttcccacagatgaaatatcacatcaccaactatagtctccgctagaaatggatcgccaaccaactcattcgcaaattgacatagtaccacataatgacgatcatataaatatcgatacgcaccttggtcgccattccgtaatttctgtactattgactgttccttaacatccatctcatcgcaaagatgagattttaaaatgaaaattaaaaatattatttctaattatacgatcttccatccacagctttttcatttaccgctccgtttaaatgaagcttcttgtagatttttatatgcgctctggttttcagtggaaggattcgggacaaacacgtacgactttcatgcaaaacacgcacatgttttttcaaaaagtcgtacgtgttttagatgaaagatcatcgtgcttttttgactctgatttttagcattttataaactagactcatcagtggtcttattgtacggaatttgtcttgagaacaatgctttccagcttaacccaaacggatgggttgccatctcatatacgtgccggtccgccataaccactccatcgggccgtagcgcaagccggacagccaatattggctaaaggctatctgtatggccgtaaatccaaggcagaccaatacactcaagaaagcacccaaatggctccaatccaagccaaaactggaaaagaattaattcacggtaagataagcaattatagtcccaatggccaaaatagcgccgatcgcggtctcataaggaatcagcctcaaccgctcacgaatgcttatatccgctaccccaccggtagcgtggaagaacgatccatgtggcaaatgatcaagtacggtagcaccggaattaatcatagcggctccccagacaccactgataccggcggcgataataatatccgcgaatgacgaagaggcaactgtcgctccggctgtagtagaggctgtagcggcagacatcaatacgccggaaaccggagccaataaaagctctcccatattcgtatgcgataacgcatctaataaaacatccttgatagaggaagccttgatcactcccgctatagtgcctgtcccgaccaacaggatcgagacattcgacatcttcttgagtccatacgagaggctgtccgtaatcaatgaccatttcctcatcgccagaataccaacgattcctccaacgggcaaggctatcatcggatcgatcgccacatggaataaagggcgaaacgacagcagtaggatcgtcactaccggagcgaccatgctagaggcgaaggaggggagatccgcttgcaggttatctatctcctcgttcgcataaaatccattttgtcggggtaagaaacggcctatgacatataccgtaaacaacaagccaaccaacgccgggatcaagttcgcatacatgacagagtacaaatccgcatgaaaattctcagcggcgataatcgtattcggatttggagaaatgatattgccacatttgcctccaccgatcatcatcaacaaaaggctaccccggggaaccgccagtttccggccgatgctcaacgcaatcggagccaccgtaataacagcaacatcaataaacactccaatagccgtcagcaacatcgtagcgaaagcgagcgcaaaaaacacatgccgttctcccaatctataaatgatcgtattggagatagaagccgccgcacctgttttcaccaatatccccgacaatactcccgccgttataattcgaatgacggccggagttacgtcatttactccactgatcattaaagagaccgtttccggcaacgacacaccccctaataatcctcctactaatgcccctaaaataaggctatagactggcgatatctttcttataatcaagaaaatcgataccaataatccgataaaagctccccatgcactcataatacccatgtgttagtgattcatatagtaatggattacacgcaattgttgttccaaggcacgcccaatattccggcaggtgaaatccttatccatcgcctgctccaaggaaaccggataaggaagaagtggcaagaccgccagaaacccggatttattaagtgcctctacctcctctacggaaccacccattacgataaccggaatatcctgtctcatgcctgcctgcaatactccgcatggggtctttcccatgcaagtctgtttatccagtttaccttctcccgtaataatcagatccgccccccgtatacattcatcaaaacgcaaggcatccagaaccatctggataccgggtttaagttcagcctttaggaaagcgacaaatcctccacctaaaccacctgcggctcccgcacccggaatgtcgtctatctctattcgtcccgttctttttatgacttccgcaaaatttcgcaagccctcatccagcaaacggaccatagcgtcgtccgctcccttttggcgggcaaagacatacgccgcccctttctcaccataaaaagggttattcacatcgcaggctatggtaaatgaagtttcccgcaattgcgataatgcccttgagcaatctatctcataaatctgattaaggatctgcccacccaatcccagctcattcccttttctatcaagaaaacgaaaacccaaggcctgcaacataccggttcctccgtcattcgttgcgcttccccctattcctatcaagaaatcccggcaaccacgatccatagcgtcttttatcaactcaccggttccatacgtcgttgtccgcaagggattacgctccgacacaggcactaacgtaaggccactcgccgtcgccatctcgataaccgccgtacgattatctcccagtatcccataagtggcctcgaccggcctcatcaacggatcatgtacgacacaatatacggcttctccacccatcgccgtaattaaagtctccacggtaccttctcccccatccccaaccgggattttcacgacctcgcaatccggaaagaccttatggattgccaactcggcacattcagccacttcaatagaagatactgagcctttaaatgaatcggaagcaacaacgatttttttcatttaccaacctttttataacatgaaaaataagatgcccaaatatataaaaaaggagtgtccttttccgaggacactcccataaacttaactaggtattctttattttgcccgtgtacatttgattacctcttgattgatgtatttaaccttctccagatccatcttttccacctttcggtcataagtgaccaagccgtttatctcatgttccacatctgtagtctgcgtatagatggccgtgcttagtccgaaatagtttatcatctgctctagctcggtaagcattaatacataggtatcagtcaagatttctctattcaacatcatctcataagcgtcattgcgtacaggccacatatgcccacgcacaaatagaccttttcctccgaattcgccaagggacgcagcacgtttatcatcgggacgggggatcgccttaggctcgatcttgccataatgatgcatatccacgaaatctccatttccgggatctccataagctttccgatagcccggagcgtaattatatcccgacataccgtttacccaacgattcggatcgtactttttcacccaagctgtgatgtctgtcgcttcaaaggctccccaattctcattaaacggaacccacatcacaatagaaggcgagctgacgtgttggtcgatcatcactttcaattcgtcacggaactgtttacgaaccgccacggaatcctcaccatcaggctcccaaagattcggcatatcttgccaaaccatcaagccaagcctatcacaatgataataccaacgttgaggctctactttgatatgcttgcgtattacattaaaacccgcacgtttcgccagttctatatcatataacaaagccttgtcggtaggagcggtaaatgcgccatcgggccaataaccttgatctaaaagaccgatatggaaaacaaactccccgttcaataaaggccgaagcacaccatctacctttcccatactaacagagcgcataccaaaataagaggatacctcatcgattatcttgccctttcgatctttcaactgtaatttcaaaccatacaagaaaggatcatccggactccatagacggggtttccggataggcaagtaaaaactcatattggaatttccttcggttcttgccacctctgaagtaccattatccgcgatagccgttacctttaactccttatcctccgtataagcaattacttccaaccgattattttttaaatcgggcactagcttaatctgagaaatatattgtttctctaccggttcaagccaaacggtttgccagataccggaggtaaaaatataatctccacgtgagccgttcttgcccgaagcggcccggccgtcgttaggatcataagcacctaccacaaggacattttcaccggatttcaaataatcagtaatatttaaactaaaagcatcgtaccctcccgtatgggtacccaccttcttaccgttgacaaacacagacgagatccgatctacagccccaaaattcaacaatacatgcctgcccttccatgcttgaggaacagagaagctacgcttataccacagacaagtatcacccccacgagctataccggataattccgattccggaggatacggcacacgtatcttttctactttcgcgggaaaggctggaggagtggtcgccgtaacaggatcaagcaggtcttttcctcccatataatcccatataccattcagattcaaccattccgaacgtgccatctgtggacgcggatattccggtaaaggaatctcagccttcaatgcctcctctgtccatggggtaggcaatgtgaacttctctaggatttgcgcctttacggagaagagatctcccccaaaaagaaaggagcaaagagctaaacaaacaacggcaatctttttcataaaccaactatttaaataattccggataatatttccggatcaaatcttgatcttctttctccaacttatcgatcaagaccggcttatcttgtgggcggagacctttttggttgattttgttgatcaagctccaatccttagccggttttgtcggggtcggatcggcaggttcatgagccggcaaatcatagcgggtaaagtcgatgacgtaagccggggaatttttcgtatgccaatcacgtaataaggccaagcggaattccttattcataaaccattttatctccaaattattataagagtctcccaaaccagagccacgttctacgaagcgatagttccagtcgtcgttcgatttatattgttttctccaaagttcgccaaattctccgaacgtaacgaaatgagtatccggccagcgttccttggtacccgttacccacatcttcatggcatcacagatgagatccttcccgaactcatgtaccatctgcgcctcccagatattggcgacccagccaaagccattcaactcaagacctttatcaaagtgaatcgcttccgtgtgcatcacctcacgatgccccaagtcaagcccccaacctttgtacgtctcgatcgggccgacacctctacggctgttgtatccatcgataccatgtccggtctgtccgctacggcgggcacagataaagtccatcgtccagccatccagattcacgcaatcgatgaaatcgctttttccctgcgccggcttgcagaagtgttccgtcgagggatagaaaggataagaaggagaaccgtcagcaccaccaccgtctatattatgctggctccagatcacggcgtgcgccacatggatgttctctttctccgccagatatcttagattatcggccgataagaaacctcccataatcgattggggacgataaccatttcctaccattttagaaatgatctctatcgcctccgacatctcacggtttacccgctcacggggcagatacatcgcaggaaaataaccggggaaataagtaacctcatccccatatttcttttggcactccactacataatcacgaatctcccggtaattcttccgtccgtcctccaaggcattcatcgtgaatccccatgtaagacgaccgttcgggttattcgtggcgaaagcctcccgcaaggcacgtactccttcaagcgtatgccaatccacctcatcgcggggatgtaacttgacatcccgggagacttcccaaggcgtcgtacgtatcatgatacataaggtgacaaaacgatttccttctatcgtcagcggttccatactcgccgggacgaccacaggatctgccgcccttaattgaaaaccactgagcacagcgaccatccatacaatcgcccattttctccaagctaatatattcatatcattatttctcatgtgtacaatttaatctcatatttgtacaatctattactatttcctgatccgacggaaacatcctaaagacataatccgaaccagattcaggtttccttatatggcctttttcgcaagtgatcacgtagttaaaaccatcgaagctagcgttgaccgccttatcctctataacggtgaaaggtagctccttccctgccgcagcctttagctctaaagcccatgagaagtccgcctcctttgatagagcgactacctcgaagcgggtctcatagaacgtgatcttgaaagcatggccttttgagtcttcggcggaaactaccaaggtatccttgcctatctccgtcactaccggatggtccaaggtaagttcctccttatctccatccttgtctaatcggacgatccgaagcccggcacgatcgagtccctcgctccacatgaatccgtccacgacgggcaacgtatagaataggaactggttcccgtctccgggcttttccagataagccgacttatagctctcgtcgaaaagatggatatccctaaagcggaacgttcccttctcccacaataagttcgcccgataataacggctgttaaaccagaccgtcttatttccttctccacggacatccgtcaacgtagtgacagccgtcgccggcgtaaccttgaagcattccttgaaccacgcaccggattcgcccagcgtctccacccggatcttattttccttcctcaaggagtccaagatagggatctgcatctccagtcccttgctcatattactccacgtgaaagagttctcctgtcccgcttgcgcataattgaaggccagacaaggcttgttcacgatcgattccaagaaataatccacccagcggcgatccatgcccgccttctcatacacgggttccaaggagatcaccccttgacgctcttgtcccagaccatcatcatactgataaataggatcactgcccagcatacggaaaataggaacggggatttgcccctcctcggtctgcgccggcatataagcgtttatccggcttgggtaataggcttggttccagtaaccaccccatagggtataaccatccgtccccacttggtctttgcagttgcacgacgccacgatcttatatttatcgtacatataccccaaggtatgcgcatcgataaaccaagaaccgaccgatttcgggtacgtgccgaatatctccttgaacttcgccatatagacatccaccagtcgctcccgttcttctttcgtatatccggtgctgaaagcgatattcgcgtgcgagacccaagaatgctcgccacgccacttgatcccggcggcctcgatctgcggttgcgtaagttcccaccaagcaccgatctcggagtgagcattgagtttacttttcaacagatcttggtacaatgggttgatcaacgcatcgtactgtaataaaaaggtagccggtaaatcatatttattcaccaatttcacttgctcacaaaccgtctcgtacaataagctatcggcgttctccacccggtagtctgtctggcggatgaaattgatgatgttgataatacggggagcagccgcactctcaaccagtttctctcccgcgctacggtatcccgcacagcagaagacgataaagcatacaagacctatcttctttatgaatgacattcgattcaattttaaattcatttactctcataaaatattctagaaatggcatttcaccggtgtaaaatcatttttagagatctaaaaagcatttcgcaagggtgcaaagccatttcttaaacctaaaaatggcatttcacaagcgcaaagtcgtttttagaaatctaaaaggtactttgcgagggtgaaaagccatttcttagatctaaaaaggcattttacaccagtgcaaggccatttttaccggaatataaggcattaccctaccaccccgggttgttcggagccaagttcgggttcagatacaactcatccaacggaagggaataatagtaatgcttcggggtcacaaagttacgattctccgccggttccacaatcaagaaaccattttcgtctgtcaaaccgggatttccctcgttcaagacatccaagttctcgtattccgaacctttcagcttaataccttttatggcacctatcaattccgtctcagccgtcttccaacgtctcaaatcatccctgcggaagccttcgaacgctaactcgatcgtacgttcccgacggatctccgtccgcatatccaacccattgctcttcacgaaagcgttggtcaaaggaggcatctccacgcctttccgggaacgaatcacattgatcgtcttgttcaagatgtcatcgctgatcgccccgtctttctcgtaagtggcctcagccaatatcagcaatacctccggataacggatgatgtgataatcatatacatccttgtcagaaggaacggaagtctccgccatatatttccacaacttataacccgtacgtgtctcgggacgtatggtaaattgcggcgggcaggtcaaggcgccgtcttgcggactgatatagtcggttccgggcatcaagaaggtctgtttcatacgagggtcacgattctcgtattcgctcttgatcgtggcatatccctcaaatccggaattagcgttctcaattggcaatcccgtactcttacacaaatacatatctgccagcttacgggtaggcgtccctcgccatccccaatatacagggcacgcgtcgctatggtggcggatatccgtctcgtaccgactgtcgaagataccttcttttgaattatcgcccgcattgataaacaagtagcggtagctctcctcaccagagccttcatataaagcatactcaccactatcgatcacttttgcagcggcatcgatcgcttgttgcaacaactgctgatagtccgaacggtgctggtgatacttcgcccacgtcccggcaaacaaggcaaccctcgctttcaacgccaaggcagcgccttgggttacacgtcccgcctcatccgagcttaactcactttgcaagggtagtttagcatacacctcgttgagttccgacaagatgaagtcttccacctcctgttgcttattcctagaaccatacaactccggggaatctacggtaagcaccttcgtcaagataggaatatcgttgtatttcgccatcaaccgaaaatgcgagtaagcacggaagaaacgggcctcagccacataccgctcgatctccgagggatcgccctcgtacgtctggctcttctcgataatcatattgctctgacgcaggtctatgaaagtagagtcccatagggcatccgtattcggggcgatcaacgtaccgttgctcgtcgtattctcgttcaactcataggcgatatcgctatccgtatccttcgtgccgaatgtctcggtacgtgtgtagagccaattgacctctttctcgaaatcatccggggttttccagaatagctcgtccggcatattatcttttggcaacaggtctatatcttggcaacttgacaagaacaaagcggaaacaataaagcttcccaatattatccgatagtttttcatgacttttcgctttaatttttaaaatacgacatttataccaaatgaataattacgggtaaacggataggaagtaatgctaccgctgttctcctccgggtcccaaccatttggcgtgttatgtacctcaaataaatcctcgccggaaaaatacacccgcaccttctgcaaaccggccttcgaggtcaaagtctgcgggatcgtataaccgaactgcaagtttttcaaacgagcatacgcaacgttaaacttcgtgttcgtagatacataataattgtagtttcgtttatccttcaacgtgatcgccggatactgggcgtccgttctttccggggtccaagtctttccataccaatactcggcggattgataccatgcctctggcatcgggcaccgactctccccttccaagaacatcgtcctacggccgactccttgtatgaaagcactcaaatcgaatcccttccaagccatactcaggttaaagccgaaattataacgcgggttcttgtcgcccaagtatttcacgtcaccggagccttctttaccatcacctaatacggatagcttcccgtctccatccaagtccttgtacatagcgtcacctacgctcaagtcacccgggatacccccttccgagaaacgagatttatacgcctccaattcttgctcattctggatgattccatcaaattcatatccgaaataggaattcaacggatatccggtcggagtctcgttattacctaatttgatcaggttacttccaacccgatccacgactttgtttttcgcgtcactgatattaaagcgaaccgagtagctgaaatccttgatctgatccctccagcctagagagatttcccatccatgaatacttaaatgtccgctgttcgtgctcggagcgtccgcacctaacatggaaggatatgtcttcgggataagcatgtttttattctctttccagaagtagtcgaacgatccatataaacggttattgagcgtcgagaaatcaaatcccacattggttgtctggatcgtctcccatgtacgagaggtagaaataatatttccagacgtagccatctgtcctttcatgccagccccgaaaggataataatcgttcgataaagagatcaattgaatataatcatacaatccgataccggactgattacccatctctccgtaagaagcccttaccttcaagtcctcgaaccaacccaatcttttcatgaagccctcttccccgacacgccaagccgcgtttacacccgggaaccatccccaacggtgatccggatcaaaacgggaactaccatccgcacggatcgttccttcgatgacatatttattggcaaacgtataattcactctggagaagaaggaattaatcgtccactgatttccctcgctccaagcgttttgatcttgggcgctacccaattgcaaagacatattttcttgttggtcgaagttaatacgcttcgccgtgaacctatcatagttctcagactcatgggaagtaccgaccatcacgcttaaatcatgccggtcattgaagttctttttataatcagcatagagcgtgaagttcttggataaagttttctggtaacgacgctccgcgctattcggcgtacgtttctcccggacctcgttattatcccaatcgtaattgatgattttcttgttcgtcacgttctcatcctgatcatacttacggatcacggcttgccccaccaattgtaatccgtcgatcactttccagcgtaattggttgttgaccgttatattacctgtagtcttattcaccatacccccgtcttccaatacttgggccggattatcgaaaccctcgaatgtatagaaagttcccgacggattgtacatcggagtccaagagcgagtcttataaatcagttcccatatattctgtccttccgtcaaacccgaggaatagtccctgttgcttgcctcataagctaaattaagatcataagtcaagttcttgaagatctcgacgctcgatttagcacgtacaaagtaacgcttgttcacatcctcaccaaatttagggataccttcctcccgctgatggcctaaagacaacatatacgagtatctctctccaccgccggagatattgacattgtaattctgcatattaccattgccaataagcatatcattccagtcttgatccttgaagaattgcggataaccggtccaacgcccccattccgcatcagtcaacaccagatcactattctgccggatcaggtccaattgatctctcgtgtattctggagtgaatgatccatcggtgatctccaaggccatctccgcatgttgtaatagattcgccggtttccttaacaacgcaggagtcttaatagagtaatatgcatcaaaagcaacagatgtcttctgattacgcttaccacttttcgttgtcaccagaataacaccatccgaggcacgagcaccgtaaatagcggccgtaccatctttcaatacggaaatattctcgatatcggaagggttgatcatattaatgtttccctccgctccatcaatcaaaacaaggggagtaccaccgttgatagaagagacatcacgaaccttcatggtcatgtccgaacccggagcgcctccggcacgtgtaatcgtcaaaccgggtacctctccctgcaaagcctgagccgcattctgaaccggacgagactcaaacgctttcgcatcggccgtagatacggcaccacccaagttcgctctttttaccgtaccgtaaccgacaactacaacctcatccatttgcaaagcatcttcccgtaacttcacgttcaaattcgcttccttgccgggacgcaattccgtcatggcatatccgatgtaagagatttgaaggacaccgttttccgatacctccattgtaaattttccatcaaggtccgtaaccgttccgttggtagtacctttctcaactacattcgcaccaataataggttctccattctcgtcggtcactacaccttgcactaaattcttcttttgcaaaacggcttgtgaggaaggggcggctttctcgttttttgtagagggattaatcaagatgaaattattctccgtaatctcatactttacgccttcccctgcgaaaagacgctttaaaatggtttccaccgtctgctctttcacatgtacagatactttcttattcaggttaaccttctcgctctcgtagataaaacggaagccagactgtttctctatcttgaaaagaacctcctttattgtctggttattaacgtccaaagacaactttgtctcttgcgaatagacagaggccgagatctgaagtgaacatgcgatagagaataatgtcgtcaatctcataatagacaaagtttttttaaggaccggagactcttccggccttgctatattccaaaaattcatatatttgtaattcgattgtttgttaacactagtgttacgagcactaattttaatgatcaaaaagatgacggggaatgttccagcatttcccgtttttcatgtgtattcatgcgattcctgttctttacttcataggcagactttatttagaggttatacttatattttttcctttcacgttataacttatatcactcaatcgggatagtacgcccaatatatccgttatggtttcctcctgtatgactccatcgtaatgtatactattccccaaatccttttgaagatggatagtcacatcgtacctcctctccagatatttacagacggaagctagcggcatatgatccatatagagtttatcttccagccaactgtacgaatgagataacacgcccgatgtcggtctcatcttgttggtttgcttatcgaaaatcgccatgtcaccggcgttcattagcaatttatcattcccatgatccaactcgatacagccttccaccaacgaggcttcaactgttttttcatccgtgtacgcttgcaaattaaaagaagttccatgtacctttaagcgtaatccattgttcattttgatcacgaacggtatcttgttcttcgagacatcgaagaagccctctccttggaaattcacttccctgatattctccttcgcgttataggaatacgtaatatcagatccagaattcagcttaacaacggaaccatccggcaagaccacctccgatcggcttccgtaatcagcggtcattcgaaccagcatttccggctgtttatcaaatactcccattttcgaaaacccgaggacaagcaataaagtagccgccactcctgaaatgatatatccgatattcaccaagcgtttccgcttattatctctctccttattgatacgatcgatcttatcccatgcgtattgagcattaaaagtttcttgctccagataagagcctgtttctttccagatctctttataccgtttaaaatcctcttgattagactcatcctcagccaaccattcatccagaaccggatccacgatctcttcattcatcctctccgataaatggtcaacgatgtgttctcctatttgctttttcttctccatgagtctagtctttatttaaatgacaccacaaataaaaaaaggtcctatacgaaccttgaaaattttctcattattttatacctccttcatctccagacattccttcaacttctgtaaagacatccatattagatttttaattgttttcacggatatagatagtttctccgatatttctttctgcttcaatccttttaccctgtgaagaagtaacacttctctgctccgatccggcaaatggtctatacaatcataaagagcgatcctaaactcttctgtttccagttgattatcttcataggatagaagtaataagtcttgattctctgataaacttcccgtctgcacctttgatcggataaagttcaaggccagatgtttagccatccgatataaatatcctgatacattttcctttatctctattctccccctatttttccataaattcaagaaaagctcttgaacaacatcctccgcatcatttctatccatcaatagactatacacatactgacaaagacgcccgtaataacgatcaaacagtttattataactgatataatcattatttccgatcgctatcattaaaaccttatcggcatgaatttcctgcatacaatctttattatcatgaatattcgcaatcgtctttacaggtaaatgagtttcggcaagactatggggatataaattcacattattttaatcttttatatattttgaggataggggtatttcatcatttcctgtcttaagataaaaacaacgagaattatggaatcaacaagtaagaaacagaatgccccaaagctttggtactggggggaacctaaaggaggaatgagccttgaggattgtgagaaaatagtaaaagagatcccgcattttgacaggaaaacccggcttgcggatatgtatatagcttttgtttgacagcaagggtttcattgtggcatttaacataaggaagagagcctgtttttatacatcgctctcttttttttataacttagcccccaattactaaatcgaagaacatgaaaaagacttttttattagcgatcgccttgttgtgcttttgcgttccgatgagcttattcgcacaaaaacagcttgctttcaaggatgggaaattcaagatcgtccaatttacagacattcattgggatcagaaatcatctaaatgcgctaagacagtcgctacgatacaatccgtattaaaggcggagaatccggatgtggcaatgctgacgggcgacgtggtgacagcaagccccggtttggaaggatggaagtcagtgatcgggatctttgaggaggccaagataccgtttacggtcatgatgggaaatcatgacgcggagatcgtccccaaggacgagatttatgccatgcttagtaaatcaccttattttatgggcgagaagggaccgggtgatatccatggagccggaaactatgtgataccggtctacagttcggatggaaagaaaccggcggccttattgtattgtatcgactccaatgattatcctacgctgaaggattatggcacgtatgattggattcatttcgaccagatccattggtatcgtgagcaaagtatgcgctataccaaggaaaatggcggcaaaccgttgccagccttggctttttttcatattcctctgctggaatataatgagatcgttggggcggagactacattaggacagaaagaagagggaatcgcctctcccaagatcaacacgggcttcttcgcttccttggtggaaatgaaggatgtgatggctactttcgccgggcacgatcatgataacgattatataggaatgttatataacgtggggctagctttcgggcgtgtatccggatgggacgcttatggagatttcgagcggggtggccgtatcattgaattgcgtgagggcaagtttgagtttgattcatggattcgtacctcgtccggaaaggaatatacgtattattatccgtctggcctgacctctaaggatgaggaaatgatggaattcttacccgccaaaacggtaaaacctaaaaagcacggggtagcttatacctattatgaaggcaagtttaaacatacggatcagatcgcttccgggacaaaagtgaaagagggtacgatgaaaaatatctccattcaggaggctccggccaaggatcatttcgcttatgagttccgtacgttgataaatatccctgaaaaaggtgtatatcgcttttatacgtattcggatgatggttccaaactatttatagacggtaaagctattgttgataatgatggctctcataatgctcgtatagcgaaaggaaaggtagcgttagacgctggtttccacgaattacgtgttttgtatttcgaggattatatgggcgaggccttggaggtcggggtttcctgccgtaaaataaaggaagctgtcttaccagaggactggtattatttaccggaataaatatccagttgtagagacgcagcatgctgcgtctcccactgtctgatagtatcttagtcttgtacggcagctttcgctttctctactgcctcattgatattactgcaaatattttctgcgccaatcttcttatcgaatccggattttgtcaatacacggtgtacatgttcattgaccccggaaagtatcatatggatatgctctgcctcggaaagacggaaaagactttccaagttatgcagaccggtagaatctatgaacgaaaccttacgcatacggatgatgcggactttcggtttatctcccatacttttcatgatgccgtcgaacttattcgctacgccgaaaaagaacggaccatcgatctcgtatacctctacacctttaggcagggagaggacttcctcgtcatgatgaatctcgccctcgtcggaaagatcgatctcatccgtggtgacggatacatgcgtggtctcggccacacggcgcataaagaataacatggcgatcaaaagaccgatctcgatagcgatcgtaagatcaaagataaccgtcaggaagaaagtcaccaacaagacggatacgtcgcttttcgggtttttcatcaaggaacggaacgtacgccactcactcatattataagatacgatgatcaatacgccagccagacaagccattggaatgtgtttggtaagcggcccgaggaaaagcaagatcaataataatacgatggcgtgaataataccggcaaccggagttcgtccaccattatttatattggtcattgtacgggcgatggcgccggtcacgggaataccgccaaaaataggaacgatgatattcgccgcgccttgggcgattagttccgtattcgaattatgcttgtcgcctgtcacaccatccgctaccgtagcggataataaagactcgatagccccaaggatagcgatcgtaaaggcggagggaagcaataagttgatagtttccatattaaacgtgatcggagccggggctggcaaggaagcgttaatagtaaaccggtctccaatcgtctcgatacctgtaatacccaaatgattacgcataatgtaaacaacgatcgtcatgatgacgatagcgatcaaggaacccggaattttcttcgttagcctcgggcttaacgtaatgatcaggatactaatgataccgataacgaatgcccaagggttaaccgtatcgaacgccccgaaatatgcgatccatttagagatgaaatcggcggggactttatccatagtcaatccaaataagtctttcatttgtgtcgtgaagatagtgatagcgataccactcgtgaaacctacgacaatcgggtaggggataaacttaatcacggtaccgagcttcaacacgcccatcaataccagaataatacccgctatgacggtagcgatggcaagcccttcgataccgaagttctgtataatgccataaacgatcacgataaacgctccggtaggtccgccgatctgtacgttgcagcctcctaaaagggagacgatgaatccaccgataatagccgtgatcaatcctttttccggacttaccccggaggcgataccaaaagcgatggcgagtggtagggcaactatgccgacaattatacccgccatgagatccgtcatgaacctctctttggaataatttctcagcgccgtaaagagcttgggctgaaaatcaaatttgttcttcatttttcttcttgcctgtttgatttgaggatgcaaagttaataaaataaagaagatgcaaaaaatctaaagacgcattccgattttgtgtaaacaatttaggaggatttgttgtttcataatataaaggtagagaagttgctccttgataaataagtgatatctatctcccgatagatattatttaatgtttgcgtaatcgatgtttggaaacaaattcttacttttgatcggtcataagaaaaacgatatacaaaacagactcattaatttactacataaaattagcattatggaaaaaagtattaaaggtacacgtaccgagcagaatttattgaaatcattcgccggagaatctcaggcaagaagtcgttacacatttttcgctagcgtagccaagaaagaaggttacgagcaaatcgcaggtgttttcatggaaacagccgagcaagagaaggaacacgctaaacgtttctttaaattcttggaaggtggaatggttgagattaccgcttcttatcctgcgggcgtaatcggaacaaccgctgagaacttggcagccgcggcagctggtgagaatgaggagtgggctgaattgtatcctgagttcgctaagatcgcagaggaagaaggtttccccgctatcgctgtagctttcaagatgatcgctaaggtagaggcagagcatgagaatcgttaccgtaagttattgaataatgtagaaacaggtacggtatttgagaaagctgaggctatcttgtggcaatgtcgcaactgtggtttcgtattcgagggcaagaaagctccggttaactgtccggcatgcgctcatccgcaagcttatttcgaaccgatgaaacagaactattgataattaaaagttgagaattgaaaattgagaattaacatagttagtaattctcaattttcaattctcaattttcaattatttaaccggcggataatcaatcgtataatgtaatccccggctctctttccgttccatcgcttgacgagtgatcaaataacctacattgatcatattacgcaactcacataattcacgggatgccttacaacgtttgaaaaggctctctgtctcctcatataaaatatccaaacggttccacgcacggatcaaacgtgtgttactacgaacgatacctacatacgcttccatgatctggtttacctctttcatgctttgagtgatcaatacacgctcttcattggtgatcgttccctcatcgttccattccggtacatcttggttaaactcatagcgatccatgacgcttaatgagtgttttgccgcggcgtcggcatatacaactgcctcgatcaatgagtttgaagctaagcggttaccaccgtgcaggccggtacaagaacattctccgatcgcatataggcgacggatgctggattgcccgtttaagtctaccttgatacctccacataaataatgggccgcaggggctaccgggatgtaatctttcgtgatatcgatccctaagctgaggcatttcttatagatattggggaagtgtttcttcgtctcttccggatctttgtgcgtcacgtccaaatagacatggtcttcaccccgttgtttcatctcgctatcgatcgcacgggctacgatatcacggggagccaaggaaagacggggatcatatttatgcatgaactcctcgccgccaaggtttctcaatacagctccatatccgcgcatcgcctcggtgatgaggaaagagggacggtcgcccggatgatacaaggcggtcgggtggaactggataaactccatatcttttacggagcctttcgcgcggtaaaccatggcgataccgtctccggtagctaccagcgggtttgtcgtattccggtaaacggcctcgcaaccgcctgtcgccataacggttatctttgacaagaaagtatgtacctcgcccgtatcctcgttcaatacataggcaccgaaacatttgataccgggggtatggcgggtgacgataatgcccatatggtgctgggtgataatctctaccgcataatggttcgtgaatacggtgatgttgggatggttgtttaccgtttctatcaagctcgtctgtatctcggctcccgtattgtcggcatggtgcaggatacgaaactcggagtgtcctccttctttatgcagatcgaattctccgctttctttcttatcgaaattaactccccatcggataagcgcctcgatctgggcaggggcctcgcgcacgactttctccacggctgcccggtcgctgatccagtcgccggcgatcatcgtgtcttctatgtgcttctcgaaattatctactttcaagttggttacggaagcgatacctccttgtgcgaaatatgtgttggcttcttcttgtccggctttacagataagtgctacgctcttgccttcattggctactttcagagcgaaactcataccggcgattcctgagcctatcactaagtaatcgaatctttgtaccatgttttctactgtttaggctcacaaagttagggattaactgattaggttgttccttttgcgcttgcttttcgtacaaaataaatattgactacaggtttcccggatagagccttgcgggttgtgttactgcaacccggcttgcagtggaggtctttagaattggacggataatcccagcgtgaaggtacgggctacaggatagatggaagtggtctcgataccgggttctacgccattcacgttgatattagcgggatcgcctccggtatatccggtaagtgtaaatacattatttaccgagaaatagcagcgtaacgattgaatccatttattgtctgggagaggaattttatatcccaaggtcaattcttctaatttcaggaaattaccgttctccagaaaataatcgcaatagatcttgtctcccttgatggcgtcgttacgggtataagcgtcttctaaaagattggtaaccggtacgttttgtagcccgtagtacatttgtttcagattcaacaggtcgtaccccagccaagaggtgaaaaacaatcgtaaatcaaaattcttccaagtaaacgtatggctgaaagagagctgcactttcggtacgccgttgccgataaaattcttgtcttcctcggttcgttccgtggtcgggatctttctcccgtctttgctccataccaagatattaccctcggcgtcggttccggcatagcgccaaccgaaaaaggagccgattggctttccctcctccaagcggatagccgggccgggtaatccgggggtgggaagatcatacagataggtatagcctagcttgaactgattgttggaaagacttttcagcgtactgctcaataggctacccgtgaggcttgccgaatattgaaagttcttggtacgcacgggcagccagttcatttcccattccaatcccttggagtcgatagtacctacgtttgtcgtgatattgtcatggatcatgggaggcttgattgcgttgtagacaaacaggagatcttttgtcgtacgtttgaatagattcaaggagagcatgaggcgggagttaagtaagatcgcctcggcgcctatgttggtatgcaggcttttttcccagcgtaaatccggattggggttattgctaggtccgaatacttgtatccatttgccatctaccatgactttacccgctccggcgtacgtctctagcgattggtaaggggagaaattatggcggcccgataccccgtaaccaaccctgaatttaagatcgtccaaccattccgtttggaaggcgggtaactcgctcaagcgtataccacccgaaagggcagggaagttgccccatttatgattcgccccgaatttactggaaccttccctgcgaaacgaggcggaaagcatcaataagtcccggtaggaataattaaaccgggcaaagacactaatcaacttgctggaattcttgaacgagcttaaagtcgcttttccatcggttagataagaaccggtgcctatgttgttccatgtgaagaagtcggtaggaaagtcggcatttccggcgttcattcccgaatgatcccaacgttggaatgaatagcctatcatcgctttgaccgtgtgctggtcccacgctttatcgtaatgattcgtccagtctagcgtccggtttacatatttggaagaggtacgatccgctcgccctttccggttattgtctacggattctttggcccgtgaggtccaatagacattttcctcactctcttcccggttctcggcgagcataatggtggagtaaaaaggtttgctccagttgatccgtgcggttagcgagccggtcataaactggttctcttgttgccggttttcctcttttagtgaggctacgggattatcccgctcgaaaccggaaggatagagatactccgtctcctcctcatcggtatagatcggggcggtaggattggctagcatcgcctgttggaaagctgtatggttacctaggcgcaaatgttgttttttgtaagcgagcgatacggttagctccagatagccggagaggaggttttggctgatatgggtacgtaaggagtattcccggcgggaggatacaatgtctagcccttgtccgtccctgtaattcatggagatacggaacgccccgcttttccatccgttttgaatggataaatcatgattttgttccaaggggcaggagcgtatcaaagcggcttgccaatccgtatggtaccctagatcagcgtctctcccggctgctacaaaggcttcgggcgaaaggacacgaggtctattatattcgtgagcggccgctaggtaggtttggtaattggcctgcaacttatccgagcttttaccgcttttggtcgttatcaagatcactccgttagccccgttcgatccgtaaatggcggcggaagatccgtcttttaataccgatatggaggcgatttcggctagtgataaactattcaaggatactccgggtaccccatctaccacgactagcggcttgtttccggccaaaatagacccggcgccccgtatctgtatatccggtatcgagtttatatcggacaaggaagatcccgagatactcattccggcgatcaatcctttgatgccttggatgggattgttgaccttcccggataagaaccgttccgaggatacataacccacggctgatgtcagttccttgcgtgccaaggttccgtagccgatcgctaccacctcgtccaaattaaagacggccggtatcaattggatctgtaaatgacggttatcgggccccaccgtccttagctccggcttataggccaaatgggagatttgtagccggcacgaatccttatccgtaaagaagcggaaatacccttcctcattcgttagtcctcctttaccggaaagaaggtcgattaccgagacaaattccatgggagaccctttctcatccgtgatataacccgtaaccgggactggatagggcttgggcttccccgtatcgatcttaggcatcaacaagatttgtacgtccatgatctcatagcgtatcccgatcggtccgcatagccggtctagtattttacggatatccggcgaggttattttctcattgattttctgtttcatatccaactgagtctcgttgtataggaaaagataaggggattgttgctctattttccgcaatacatcccttaattgagtcccatgctcattcaaggtgatgggaaccttgatctcttgggcccgtgtatgcgggacgcaaaagaacagagccgtaattaagaatgatatgtatatcttgatttgcatagggtgaattaaacggttaatagatatatccttccgagcgtttcaataagggattggccgatatcgcccgggcaggtatcggatagaaccggcgataactatcggagggttgcttatcccaccagataccggtcgtgaatagaccgaaccggtttaaatcggtacgtcttcgtttctccgctagaaattcacgtccccattcatccaataattcctgtgcggtaaggacggagccatcttccggatagcgtacttgttcccagtcttccggcgcatagtatcgtttgcgtatctggttcaagatcgcctcggccttggctggattacccagacgaaaggaaacttccgccagcgtataataaacctctgtcagccgtaacactaccagattattcgccatcagccccacgtctccggatggataaagcggatatttcacgatacggatacctgtattctcctcgccggtcttgatattggatgcgagggaggtgaatcttttatcttgtatgatccacggcgtatcggaagataattgtttatctgtgagcgctttcttttccgtatcggatagatggtcggaataacgtgctacttgatctatgaaaataagggggtaatttccccattcctcggcgccatactgaagctggtcgctattgtatatctgttggggtccgaagaggaataatccctcgtaaatgccttgtgagagtaccttgaagttcttcttccggagatccgtatcaggaaatttggaaaacgtgcgtcctaacgtataagggtagggcttgccggatggatcgtaagagggactgaggtgacaaccattataggccgccggcaaatccttgccacaaccgaatcgttcgggcgcttggtagtgcatgaaaaacagatagtaaaaatcgtcataccctacttgccgggactggggataagaccagattaattccggacaatcttgattgcccgcgttccataaatcggtccattccgaggtgagagagtaagtgccgaactctccgttgataatccgttcgcaaagcgctccggtctgttcccacatcggtatattgatgtaccaagacgcgttaaaatagagcctcatcaataatacggccgccgctccttgggtgatacgtccctcgtaattcttggagggtgccttgggtaaatcggggatggcgtttaataagctctcttctataaagtggaaattttcttgtggggtggctgaaccaacctcttcctctatcgtgagggagatcgcggggatgcggaacgcatccagaagtaaaagttggaaataagcccgtaaagcggtaagctcggcgatatgctgccgcttgtcggactctgcgagtccgaagttatcatatgataactcttggatatccgccaatgtattattacaatatccgatacctccgtagcaagcgttccacatttgctcactgtttttctcgtacgtgtcccatgtatgttggtggatcatacgccatacgcccccgtcttcccaatgctctcgtttttgggtgatcacgagttgatccgccgataactcttgcagccagaaagagaaattagtctccgcccatttcgcatgctcataaggacggagtacggaggccattaaggattcataatccgtataataatcctctttctccagctggtcgtataggtcttcttccagatcgaagcaggagaagagcaacgggagaaaaagaaaggttaacagcagtggcgcgtatctcttcattgaataagaatcaagttcgtacccgtgagtttattggtttgttgtaatacggtttctaatttttgtgtctttagaaaagcgccggagaaacgttgatcatcgttttccggacgtgtgtacatgagtgagaccttataggtttgttcgatcaagcgtacgatttcatctagggaagcgttatcataaaagatgatcccttttctccacgaggtaagccgttcactatcaacttccgttaccgtataatgttcgtcattcacgaaataatcggctttttggttcggatgcaactgtaccaattctttctcatgtgcgttattcaggctcacctttccttctaccaagatcacggagatctcgtttccttgatcggaggtctgtacgctgaaagaggttcccagtaccttgaccgataagccggaagcatcaactataaaaggctgctcgctattgggagtgacctcaaaaaaggcttctcctttgattttgacctctcgtacggaagaggcgaagacctccggatagcttagctcggaattctctctcaaataaacggaactaccatcgggtaaaaggatcgaacgatcctcttgcgcagctataatcgtttgccattcggcatttcctgttcccgcttttccgccttgattcaagaaatagacggtaactccggatacaagcaatagtaagaccaccgctgctatcgagaaccatattcttcgggaagaagttgagaccaaggaaataaccggtgcctcttcggtttgcgattgagattccgagggcgtgatgatcgaagcgatccgattccatttccggtccgtttccggatcggcttcagcctcttccaaaggattccattcggcggttcgcttccggaaagcggtctcccattccttggaggcatggatggcttgaagcaactccgcttcttcctccggggtcgccttgcctttcagataccgtgtaattatatgttcgaatcgtttattctccattttcctgttttactaaatctgtattaccatttccaaagactaaggagcgttcccagtaataaggcataacgccttaatccatcccggaatcgtttcaaggcacgggtaatgtgtttctccaccactttctccgtaatagccatatgttccgctatctcccggtttttcaagccgttcagacggctgagaacgaacgcttccttgcatttgggcggtagttcctccataatctgatcgatcgagtcggacagttccttttgcatcagcaaggaggaagggtcgggtacgaaatccgccgcatataatcgctcggcagtctcggtatccggtatccgttgctgtaccgtatcggctatctgacggtgttttaaatagtttagacaactattccttaccatcatgaaaagaaaagaggtcagcgagatgttatccagcaactcccttctttcccataatttcaagaatacatcctgtacgatatcctccgcctcgtttgtatcgttggtgtatttctgggcaaatgcctctaaacggggagagaacttgcgaaaagcgtattcgaacgcctttgcgttgccccctctgatcttatcgaaaagaagacgatcatccgttagatacaattgctcacacataccactttagataaaagattgaggcaaatgtaacaaaagtattctattttatgatcaaatcaatttattatataacaactaggcccgcttttacccgccctttattcctgtaagattattttatgtccgagaagggggggattccccctcttggttgttttatcaagcaaacgaaataaataaaattaatttagtaatcttaaattgtaaagcatgaaaaagcatttcttctctttgcgggaaagaggtttgttcctacttcttttgggactttttctttcctttagcagttatgctcaagacattaccgtaaaaggtgtagtgaaagactctaaattcggcgatccgattattggagctagtgtccttgtgaaaggaacaacgaatggtacgatttccgatatggacggaaatttcacgttggcaactccgaaagacgggactctgaccatctcttatatcggttataaatcacaagagatcccggtaaatggacagcagaacctgaatatcattctggacgaggatgtagaggcgttggacgaggtggtagtagtaggttacgctaccggtagcaagcgtacgatctccggtgcggtagagcgtatcaagaaagaggatatgaaccaaggtgtggtaaacacgccgttggaatccttgaagggtaaggttgccggtgtggtaatctccaagacgggtggcgaccctgcctctaagccttctatccgtgtacgtggtacgacctctttgtccggtggtaatgatcccttggtgattatcgatggcgtattcggtgatttgagcatgttggacgcgatcgctcccgccgacatcgagacgttcacgatcttgaaggacgcttccgagaccgctcagtacggctcacgtggtgccgccggtgtaatcgtagtgactacggtgaaaggtaagaacggtatgaagacgttgagttataacggcaacttcggtatcagtaatgtttataagaacttgaagatgttatccgccgatgagttccgctctacggcgaaggcgttaggcatgactccgctggatatgggaggtaatacgaatttcttcgacgagatcgagcagttgggttatacgcagaaccataacatctctttcggcgcgggtaacgacgattcgaattatcgtgcttctgtaggcgtgatcgatcaacagggtattatcaagaatagcggtatgaagaattatacggctaaattggacgcttcccagaatatgttcaacaataagttgaaaatcgagttcggtatgttcggttccttgaagcaagtggattatacgaacgattatgagaaaactttctattcggccgctacttacaacccaaccttccctacgcataagaatgaggatggcaaatgggatgaggatccctacgcaaacgagatccagaacccgctgggacgtcttgagatacaggatcgtgagaagaacgcttacgtgaacgtacacggtaaattgacttggacgattttggacggattgaaactgagcgcattcggctcttatacgtataacgtgaaggagaacatgaagtatatcccgaaagatttgaaagcgattacgcagacttccgacgctcatggttaccgtgcggataataagcagaatatcttgatgggtaatatccagttatcctataataaggatctgaacgagaaacatcatatcgacgctttgggcttgattgagggacaaaaatatcattatacgggatttagcgccggtgcccgtggctttgagacggattacttcggttataacaacctgaaagcgggtggtacggtgaaatacggagacgtgacttctttccaaaacgagaatcgtctggcctcattcatgggtcgtttcaattatatgtatgacaaccgttttatcgccaccgtgaacttacgtgcggacggttcctctaaattgggtatgaataataaatggggcttcttcccttccgcttccgccgcttgggtgttgaatgaggaggctttcttgaaagacgtggattggctgagccagttgaaactacgtgcgggttatggtctgaccggtaaccaagatgctatcgaggcttataactcgttggctttgatgagcccgaacggtgtgacttccgtcaatggaaattctaccgctacctatggctttacacgtaactcgaacccggacttgcgttgggaggtgaaaaagacattcgatgtgggtgtggacgccggtgtcctcgatggccgctttacgttgaccgccgattggtatacttccaagactacggatctgttgtataaatatgcggttccggttcctccgttcgtatatccggaattattggcgaacttgggagagatgaccaactccggcgtggaattggctgtaagcggtggtatcgtgaagacaaaggatttcgatttcaacatgggcgtgaatttctcttaccagaagaataaattgaactccttgagcggttcttatatgggacaagagttgcaggcgaaacaatatatggatctgtccagtatgagtggtgccggtttcgtaggaaacaaccgtgtggtttatcagatggtaggccagcctgtcggagtgttctacattcctcgttgcttgggcttgactccggctttggatgagaatggaaacgctatcgaaggccgctatatctacaacttggatcagacgatcgatggaaaagagggtttggataccaatgatggtggcgaccgttatatcgccggccaagccatgccgaaatattatctgggaatgaacttcagcttccgctacaaacgctttgacttgatgacgcagatgaacggcgctttcggtcataagatcttcaatggtacatcgctagcttatatgaacttgagccagttccctacatacaacgcgttggctaaggctccggaaagcaagatctacgatcagtcgatctctgattattggttggaaaagggtaattatttgaatatcgattatattacgttgggttacaacatcgattgcaagaagatcgagaaatacgtgaagaatatccgtgtgacattctcggtgaacaacgtggctacgatcacgggttactccggcttgtctccgatgattaacagtacgacggtcgataaagataataatgacctaggtatggataacaaacgtttctatccgttatcccgtacgtattcattaggtttgagtgttaacttctaaatccatttaaagagtcatgaaaaagaaatttatatatagctttatgatagccgctgccgccgcggcattttcttcctgttctaattttttggaagagcgtcctacagacgcgtttgatgaggagaccgcgttccaaagccctacgttggtctatgtaaacacggttgcgagcctgtacaataatatgttcaagatcatgggtaacgaccgtcatgtatatgacttgaataccttctccagcgatgaggctatgcttccttgccgtatcggcgactgggaagatggcggtttatggcagaatattttcttacaccgttggggcacgatgaatgatttgaccaagaactcttgggatttcttgtatgagcagatcggaaaatgtaaccagagtgttgataagttgcaagcctttgccgaggaacaaccggacgtggaatatttcaaggtttatctggaagaggtccgtgcggtccgtgcgtttttctattatgagttgttggatttgttcgctcgtgttccgttggtaacttcctctacgacaccgatgtctgaggtaaagcaatctgagcgtagcgttgtatttaactttgtccgttcggagttggaggaggcattgccttatctttcagataaccgcagtaaccaaaaaggtgagtattacggacgtattaccaagccggtggcttatatgatcttggctaagttggcgttgaacgcggaggtttatgcggacgacaattggacggacggcaatcgtccggctggaaagaacatcaagtttaccgttgacggtaaagagatgaacgcttgggaagctacgatcgcttatgtggataagctggaggctttgggctataaattgcagggaaacttctcggagaatttcgccgtagcgaacgagacctcggttgagaatattttcacggttcctatggacccggtcgcttatccggacgctaaggactacaatttggtacgtacccgccattatgatcatgcaaccgcttacggccaatccggatggaatggctcttgcgctacggtgaaggcgatgaacgtgtttaagttcggtacggcggatgaggatcctcgttgtaagcttacttattttacgggcgaggtaaccggtccggacggaaagacgatctatacggaatgggacggacagaaagtgcctttgaaatatgagccgaacgccccgaaggtatatatggatgcctccgatggtttgttggtgaagaccgccggagctcgtatggctaaatatgagttcgaccagaatgctcaggatggtggaaacttgcatggaaatgactgcgtgatcttccgtttcgccgacgcgttgctgatgaaggcggaagccaagattcgtctgggacagaatggagacgatgaggtgaaccaagttcgtaaccgtgtaggcgccaaaccgctacaaaacgtaacgctggatacgctattagacgagcgtatgcttgaattagcttgggaaggcgtacgccggcaggatttgatccgtttcggtaagtttaccgaggctacggtagaccgttatgtaggcgtgaaacattccgccagctcactggattatcaagaggataagacgggatatacaacggtattctccatctatgccgatatccttagcctgaatcctaacttgacacagaatccgggatattgatacgattcattttagttataaatgctttattaagggggctgtccgttattgggcagccctttcttctttttgcttgattttccctagtatcttcgggaatttccatataaataacaacgtacagcaaatagcggccgtggcatccgatacggcttctgccgcgtatacgccggttacccccataaaatgaggtaatagtaatgccaaaggaatcaagaggattactttacgaagcaaggcgataaagatagatatcttagcttgtcccaacgctacgaacatattctggcaagctcgttgtaagccaaaaatcgtcatacccgccaagaagatgggcatgacccaacggacggtatcgatcaactcctcgtcgcttgtaaaagcggaggctacggttgaggggaataagatcatgaatagcatgagtatcaagttgaaagagaacataacgattagcacgatacgaaaacaatcttttacccgctgtttgtctccatgtccgtaattatagcttatgatcggtacgaatccttgggcgaaaccggtcagcggtacgctggcgaattgcatggcactctgtaagatagccaatgcgctcacatagatatcgccaaaatttttcaaactactattcaagacgaaaccgaccagactctccgtgctggccatgatgaacggagaaattcccaaagcgaacatcgagagtacgattcttcggtccagtctcatataccgcctttccaaagacaaggaggcacgtcttgagaaaaggaagctcaatacccatatggcactgcaagcttgcgataggatcgtggcgagcgcggcgccttttacccccatatccaaccagaaaatgaagatagggtctaatacgatattcaataaagccccgatcaaaaccgagcacatagcgatagacggacgcccttgtgcgttgataaaggcattcaagcccgtggatatctcgacaaacagagtgcccagtaaataaatagagagataatccaccgcatatcctaacgtatattttgatgctcctgtaaaaagcaggatcggttccatgaaggtataggtgatgagggaagtgaatatagtaaataggataagcaatataaatccatttcccactatttttccggcccgttcccggtcgccctgcccgagagcgatagccgctaacggtgaacctcccgctcccacgatagcggagaaagaagagatcaagatcacgatggaggtggtcacccctataccagccaaagcgtttgtcccgatctcgggaatatgcccgatatagatacgatctacgatattataaagtaagttgacaaattgggccgctaccgccggaagcgccattttgaaaaccagcggtagcatacgttccgtacctagcctagcctcgtatttgttcttcatattcaatcgggatttcaattaaaatggctgcaaagttacaagaacttgttggattatataatcgagttccataaattaccagttaataaaaaacacttaatatctaccacatctacaattccttcttatatgccttataaataaacatcttatatagtggttgtagatagaaaatatctacaattatcattctttatctaccatgttttgatagaaaacgcaagaaatcaaattatcgtttaggttcgtgtgtcgtagtgcctatatatgtaaaagtagtttctattagggaaaacaaaagtttcgtgctgaagaaactttagtttctatatagggaaacaaaagttttctgattgataaacttttgttttttaccataaaaaactgcaaatgcttatatgctaatattttaaatacataatacaactagtagatacgtagtgtgccgcgtctccctgctggctgattgtatctcaaaatcactattgaaaaacaaatattttagtggtatttataaaataaattttataacttgcgtttaagttgtaaactgtaatctaaatgaagagaacactaggactgactttgctacttttcgctacccttttcgcgtacctttgcaaatgactaaaagaatcgatcgtttaaactagtcgtttctatcccataaaaaattctcaaatatcaacgtatttaactatacattaatgtacgagcgtacattaaaagaacaattcatttctactttcaattatctatttatattttacttccaatacagactatttcccgcgaatctccctgtcagtaaaacagcattcatacaatccttttgactgaaataaagcgcatatcgtgacataggctattcgtaaaagaggcaagataatgagaaaaaggaggttgtaagcggcgttttatgcggcaaagtactactttttacacacgagtatcgacaaaagcctacactatcggtcgtgtttggcaacgccaatagtgccgttaggcatcgtgaatagtcaagaatagggtcgtgaactatcaagaataaccatcataaccctgtcacttccctatcgtaacccattgagataggtttttcatcccataaaataggaattaggatgagctagtttcgctagaacaaaagagcatcttttgatatccaactatccaacaagcgattaaatatattttaactcaaatttaagagtagactgtacattcccccgcaataatcgattctacgggcgttaagattacaaactgtcaaaaagaaagaactcgacacagggagccattggttatcaattcagtcaaataaaacagcctctttccttatttcttctccaatatgactatatattcattgcacatcgtgctaaccttcttccctgccacattagtaggacttgttttggaaggcatccttttgttaggtatttctctaacaatcgtatcgatatgtgtaaaaccattcttctcaaacatttcagcagtaaagtaatctaatggaatttgaacccccttaaccgttctgttccctacgacataacaaacgactccaccactctttattacagacgcgacattctttatagaacagctataatcattaagaaacgagaccacttctaaatttctctttgggtcaatgctctttatttcgtccagttcagatttaatgcttttagtctcaaaaagttcctctttctgaactcgtccccccattaggagattatctagtgttttagcattttcaaaattgaaccattcatttgcccaccttgaaaattgtccataagcaacggttgttctactatcgccataaggcggagaggttacaaccatatcaacactattcggctgtattatatcggaagggatttctatagtactattaaagccatagatacctatattacatggatattttatactattaaactcctcaagtccatttatatttcttataaccttttcttcaaacaatcgaaagacatccggtttgaagtctttaattttctcttccttcatcctaaaccgcttgaattctccattcctcgtaaacgatacctctctaacagtctcggaaagaggaactttaaagaaatcagcgaaatccaaagccacacattcattaattacttgataaatataagaaaggcgcaaaaggctatctctggaataccaataagtataattagaaatattatcgaagttcttattcttgaccttatcttcagaatactcaaagaacaaggcttgcatcattgaaaaagtatctctgatacaagataaatcataatgggttgtttttacatggctcatcaatctagccaatggattaaggtctgttcctatcgcgtttataccttttatagaagcctcaactaacgatgtaccgcttcccatatatggatcaaaaagtagctcaactccatcctctggcttatattcctctattagagctcttgctacttggggaatcatcatcgcaggatacgcatgatagcaatgagtaaattctttggtatcggcatccttaaagctccacctattatcaatcgttcttttgtacataccttccttacttatattatgtgagtgcaaatatactcaattgctcacatattgtgagtacataagcatatataaaactatatttttgggcaaaaataacaataatgattagaaagaccgagtatcaacttgaaatcatccttaagataaaggagctaagagaggccaacaatgttagccaaaaagagttgtcgaatctcctcgaagtggctccgggcttaatagggagtatagaaagccctaaatttccacataagtacacccttagtcagatctataaaatatgccactatttcaacattaccatagaacagctattcatatcagaggaagatttttccaaagatagagatattattgacttactcatatttaatataatacgttatggagaataaggattttattatttcaaagttcaaagaggttaaatccttggaatatgttccaagcaatagagccaacaatactgggattggaaaaacatttgaagattacatcggagttgtcgagaacaatttagacgagcccgatttagctggattcgaaataaaatctcatcgcggcgcttcatgctcttacgttaccctattcactaaaagcccctcatttcccaaacgcgcgaatgcttatttaaaagataaatttggaacaccttatgaagatgcaccatctataaatagcttgcatacgtctatgtttgcaaatagctataacacatatatgaagaaatattcttttaaactcctaaacaaccctgtcgccaagacaatattaataggagtatttgacttaaatacaaaagagctgttagattgtagcgtaggttacacctatcaagacattcaaaaagcactaacaaagaagctaaagaacttattatatgtaactgcccaaacgaaaaaagaaggaggtaaggaactcttctacttcaataaagccgatatatatacagagccatcatttgagcgttttatatcactcttaaccgatgggaagataatgtatgatataagaatcgggagctataaatctggccccaaatatggtatgccgcacgatcatgggagtggattcagaatattagaggctaatatcagactattatattctgatcacgaaaccatagaataaaacaagctacgcttcatttgttggcttctgtatcaagaccggagataaataccatagggtttcaacgataataggctcaatatcccaaccggatattatccacccaaaaggtatttcccggagaccctatgtatgagcctccgtgactggaacagaactctaagatcatatgggttacctcatcgtcctccgttccccagccgatttcttggacagggacgttcttacctttgctgtttaaactataacgagcggactctccgagttgaaaccccatatattctttataatcgctacgtttcgtgatatcgccgtataagatcgtgaaattggcatcgtttacccaatccgtatttttatccatccggattaccagcgtaccgatacgcttagcatatatgttcccgtccttatcttcccaacgcttctgaagaaagagattcaccaaaggcatatcaatgccatttacctccgatctcttgctaaaaccgctcaatttaatacgattgggatcaccggagagtttcaccttataatcgaataacaaggacgtaggtttttggtgaaacgggataccgcaaacgatctgtccccacgtctccgaagaattcttcgccggttccagaaaacggccgagatagaggcatcccccgaccaacaccttcacgttcatgatacccatcgccgagatcgattctatccccgtctccagccgtgcgcaatacccctcatcccgtctttcggggtagacactgacgctagctttcgtaatcccgctcaccctagccatcacgttagaactgccccaaggcgaagctttcgactcaaaaggtctatttccgataatcgtatccgtagggccaacgcagtaaagtgtcttcgtctccttcccgataatagccgattccgtgatcttacgtaccacccactgatccagatcgccataacggatcacttccgtctttcgctgggcatatagcgccatactcatccccaaaaagacaaataaatagcctaaccgattatttactaccataagttaccctcctatccaaatccttttttatttttgcagcgaaattaattagaatcgataacacaaggcaagtccgtataaagaatttattcggattatccatgataaataacaaacgacgtgaataaacccatggcagaaaagccccggacaccctccatcgcgatctctttactacccgtagtgacattagtcatcatgctggccgtagccatctatattttccggggcgattcccttggaggagccagccaaatcgtattattgatagccacctcgatctgctctttgatcgccgtctttcattgcaagatcaagtgggaagatatcgaggggcaaatcgcccgtaacatctatgggatcgcaccgtccgtcatcatccttttattgatcggaaccctatcgggcagttggatggtaagcgggatcgtgccgaccttgatctattacgggttgcaagtcatgcaaacggatttcttcctcgtggcctgttgcctgctatgcagtatcgtatcggttatgacgggtagctcgtggactaccatcgccaccatcgggatcgccttgatcgggattggcgaggcgcaaggcttcagtacggggtgggtagccggagcgattatatcgggcgcttatttcggggataagatgtcgccgttatcagacactacggtattggcggcctccgtaacggacacgccccttttcacgcatatccggtatatgctttatacgaccgttccctctatgatcgtcacactgatcgtattcagcatcgccggattctcgagggagacagcggacgcgtcccagatagccgctttctccgaagccttgaaaggctcgttccatatcacgccttggcttatgatcgtaccgatcgttaccggaatcatgatcgccaagaagacaccttcgatcgtagtgcttttcgcctcttccatactcgccggaatattcgccttgatcttccagccaaacgccttattggagatttccgggatcacggatagcggaattatcgcctatatcaaaggcctgctgatgactttctatgacagcacgcagatacagaccggcaacgaggccctgaactctctagtctctacccggggaatggccgggatgatgaacacgatttggctgatcatttgcgccatgtgtttcggcggggccatgtccgctagcggcatgctggaaagcatcacacgtatcttcttgcatttcatgcgaggccgtaccagcatggtcgcctctaccgtcgtgtccggattatccttgaacatctgcacggcggaccagtttatcgccatcatcctgaacagcgaaatgtttaaagaagtatataagcaacgtggattcgagagccgcctgcttagccggacaacggaagactcagtcaccgtcacctccgtgctgatcccgtggacgacttgcggcatgacgcaatctacaatcctcggcgtatctacttggacttatttcccttattgcgtctttaatatcgtcagcccgtttatgagcattcttatagcggcaaccggttataagatcgtccaaaagactgtgaaataaggaaatcaatctataattcatagcgttattcaaggtatttttagtattttcgcaccatcattatttaagcgactgaatgaacaatggaaaatcatcttaagaagatgccctcccctctactttcactagtgcctatcctcgtgctggtagctcttttgtttgtaaccatacgcacttttggcagcgacgcgttgagcggcggaagccaagtcgtattacttaccaccacggcggtcgcctcccttttggccatgatcttctgcaaagtcaaatggcgtgatatagaagaggcgatatgtaaaaacatattgggagtggccacggctataattatcctattgttgattggcgccttatccggtagctggatgatcagcggtatcgtcccgaccttgatttattacgggatgcaaatcatccatccgagtttcttccttgcctcttgttgcgtgatctgcgctgtcgtatccgttatgaccggtagctcgtggactaccatcgccacgatcggtatcgccttgatgggtatcggtgaggcacaaggcttcgctacgggttgggtagccggggcgattatctcgggcgcttatttcggggataaaatctcaccgctctcggacacgacggtattagcttcttccgtaacgcatacccctttgttctcccatatccggtatatgatgtttacgacaataccttctatggtgatcacgttgattatctttaccatagcaggttttacgcatacctcgaacgcctccggacaaatagccgaattcgccgcctcgttgaacgaaagctttaatatctcactctggctgctgatcgtaccggtggtaacgggtatattaatcgccaagaaagtaccgtctttgatcaccttgtttatctcgacagcgatggcgggagtgctcgcgatctttttccagcctcatttattgcaagaggtagcgggagcatcggtagcggatgcctcctccctgtttaagggattattcatgacattctacgggagtacccaaatcgatacgggcaacgaggccttgaacagcttggtcgccacccggggtatggcgggtatgatgaatacgatctggctgatcatctgcgccatgtgcttcggtggttccatgacggccagcggtatgctggaaagccttacgtccgtattcctgcgctttatgaaacggagggtcggcatggtggcgtctaccgtattctccggtttattcttgaatatcgttacggccgatcaatacatatctattatccttaccggaaatatgttcaaggatatctacaagaaaaaaggatatgagagtcgcctgttaagccgtacgacggaagattccgtaaccgtaacgtccgtgctggtaccgtggaacacctgcggcatgacgcaagccacgatattaggcgtagcgaccctgacgtatcttccttattgcttctttaacctgatcagtccgttgatgagtattacgatggccgccattggcttcaaaataaagcaacaccatgaagaagatcagagtatcattgttaactaaagtcgttatcgctatcgccgccggcgtattgttcggccagtttttaccgggaggaatcgcacgtatctttgtaaccttcaattcattgttcggcaacttcctatcgttctccatccctctaatcatattggggctggtgactcccgctatcggagatctgggtaaaggagccggaaagctattgttgataaccgccttgatcgcttacggttcaacagtcttctcgggtttcttcacgttcctgagcggatcggctatattcccgcacatactaccgaccaacacggaattgacggcgatggagaatccggaagatttcatgctgacaccttacttcgtggtaaatatgccgcctttaatggatgtcatgacagccttgctgctatcctttacgattggcctagggctttctaatatagcgggaaccaccctgcgtgactctttcacggatttcaaggaaattatcattaagctaatcgaggtggttatcatcccgttattaccgctccatattttcggtatcttcctgaacatgaccgtgagcggacaagtcatgagtattatcacgatgttcctcaaggttatcatagtcatctttgtcttacatgtattattgttattgattcaattcacgatagccggaaccatagccgggaagaatccgctccgcctcttgaagaatatgttaccggcctacgctacggctctagggacccaatcctccgccgccacgattcccgtgacactggcgcaggctgtcaagaatggcgtacgggagaatatagcgatctttaccgttccgctttgcgccacgatccatctggcaggtagcaccatgaagatcgtagcttgcgctatggctatcatgatcatggcgggagaaccggttaccttctccaacttcagcggatttatcatgatgctgggaattacgatggtagcggctccgggggttccgggaggggctattatggccgctttgggtatcttgcaaagtatgctgggattcaatgagacactgcaagcgttgatgatcgccctttatattgccatggatagttttggcaccgcttgcaacgtgacgggagatggcgctatcgctgtcgtggtggataaaatagccgggaaaaacaccccatagttacctagagtagcaggaagccataagcgcctccaaggtatcgacctctttttcccgcatcatcgtaagggcgatatgggcacaggcgtaagcgtcggccatggcgttatgatgttgggtaaggtcgtaaccgcagtgggcggctactgtctgcaactgatgatttaccagaaatgggtacatcttccgggatagacggcaagtgcaatagaagggatatttcggataggctaagtcatatacctcgtgggcggctttcaggcatccctcatcaaacggactgttatgggcaacaagggggagatcctttagtttcggggcgatgctttcccaagcctcctcgaaacataacgcgtcattcgtatcctcagcgctcaacccatgtatagccgtagtccaacgggtatagaaattaggggtaggacgtaccaaggtataaatgctatctactacccagtcatcctccaatatggcgatacctatactgcaaatactgctccgctttccattagcggtctcaaagtcaatggctgcgaatcgttccatagatagattactagtttttaatccgtttactatttatttgtagagacgggcgtgccccgtctctacaaataacctctcattatttatggctccagtcccttggtgcggggacaggggctagcggtttgcgttcttttaattgtttcatgacttcctcgatagcacggtctaactgttgatcctcaccgttccattccttgatggggtcgttatcgatcaagatatccggatccacaccgtggttctcgataatccagttacccgtcttcggatcatagctcgtgaagaaaggcacacggatatccgtaccgtccatataaggaagcggaccactaataccgatgataccgccccaagtacgggttccaatcaatttacctaagccaagcgcacggaagccccacgggaataaatcgccatcggaagcggaatacttattgatcaagcaaactttcgggccaacctgtacggcatccggcacggtcccgatcaaagaagaaccccggcgcatcgtcaaacgatacggctcacgagacagacgttccagaatcatcggggagacatttccaccgccattcgcacgatcatcgataatcaaaccttccttatccaattgcggatagaaatagcgagagaactcattcaagccttccggccccatatccggaatatagatataaccgaccttaccgttcgtcgccttatctaccttcttgatattatcttggatccaattatagtgatacaaagaatattcttccgccaacggactgaccacgatcttacgagcccccgccaactgaggcttgctattcaaggacaactcggtcggaacgttcgccttcccgatcaacaacttatacatatcgttcacgctattcgcaggaaccccgtctatagcgacgatatactctccagccttcgcctcaacacccggttctgtcaatggagaacgtaattccttactccaagaagcccccggcaggatcttttccaagcggaagaaaccactcttatcccgagaaacctcagcacctagcagacccatcgatacccgtttagggctttccacctcaccggggttcacataagcatgccctactcccagctcgccgatcatctcgccaataatataattcaagtccaaacgtgttttcacgtaaggaagaagggcggcgtatttctccttgatcgccttccaatccttgccatgcatattctccagatagaaaccatcccggaaagcacgccaagcctcatcgaagatttgcgcccattccttcgtatagtctaccgtgatcttcatattcgccagattaaccggcttacttaaatccgctttacccttcggtatatcggttacgaatagttgatcgtccttaaagaaaacagctttcttgccagccggatcaaccatcatagcggcatcgctaacggtttcctctttctgtttcttcaagtcaaacatcttcatgccgcctttcgtgaaataatacacgttcgttccatcggaataaagatcgtagtaattcgatcccggcaaggggagcttaacgattcgatccgtaataccctctatatcaatctttacaaccggagtagaagcctcattctttgtctcgtcctttttagaggcatccgctttcgccggggtagattcaatggctacctccgcatccgtttccataaacggggaagcggtatccttagacaataacgccagatatacgccacccatattattatacacatgattccattccgtttggctatacgtaggattgaaatcacgggcggaagtgaataccagatatttgccatccgtactgaataccggagaataagactcgtaccatttatcggtcacgggatattctttcttacccgcgatatcgtagacatagacgatcgagaaattattatcggacacacgggaataagtcaaccaattattatccggagagaaacttacgttgcgggcttcacctaacagactttgtgagatagttgttagctgtttgttagatacgtccaaaagattgatacgatttttacgatccgtatagacaatcttcttggaatccggactccactggaaagtacggatatacgtatcgttattcttggtcaacagggtaggctcgcccccctcggaatcttggagatacagctcggtctcgccggtagcatcggagatataggcaatatactttccgtccggagaccattgagcgtcacgttcgtgcgctcccggagtacgggtgatatttttcgtaacccctttatctaccgggatattgaatacctcgccacgagccgtcaccaccatacgctcaccttttggggagaggctggcactcgtgatatatttggagccatccttgatctcgctacgtgcgtagacattatcggaggccagggttacgttcactttctccggtttcttcgacgccgcatccatcttatagatatagcctccattctcgaaaacgatcgtattgccgaagctgctagggaatttcacgtcgtactcggtgaagttcgtcaccttacttgtttgttttgtcttcgtattgtaaacgaacaagttcatcgtgtaatcccgatccgaaaggaaatagatctcatcaccaatccacatcggaaagatatcttgcgcctcattgttcgtgatattctctacacttttcttctccggattatacacccagatatcatcggccataccgcccttatagtatttccatgtacggaactcacgcattacccggttgtaagccaattgttttccgtcgggcgaatagctacaaaagccgccctcgggcaagggaaccacctcggaaaggccaccttctttatttaccgtatataacttgccggagaacccatcgctgatgcggttgcggtaaacaataccattaccgtccggtgtccaagtcatcacgatattattcgggcccatgcgatcgcccagatcatcacggctattcgtagccgtgtaagtgatacgcaatggctcaccgccggaagagggcatcgtgtacacttccgtgttaccgtcgtactgtcccgtaaaagcgatcgtcttaccatccggggagaaacggggaaacatctcataccccacatacgatgtcaatcgctgtgcctcaccacctgtagccgggaccttatataaatcgccagcgtacgagaatacaatctctgaaccatttgtagccggaaagcgcattaatctcgcctcatccgccgccatcaacaacgtagggatagcgacagccgccaatgctgttaaaatcattcttttcctcataaccaatcttatcttttaatcatatctgttctatccgtttttagttgggccaatagcgggtaagacctcaaatgtacataaaaagatccaaaatccaagtcaagtcccttatatatccgatcctagaaaaagttttagaatctctaatttattactacctttgcgccggaaatcaaacaatgatacaaataagatgaacaagaagcttctgaacaactcaaaaagatggtatacccgggctttctcgggtaacacgatcgtgcatgttcattggttcagcggttttgtctaaatccatccatactcttcttgagaggacttctttttatagttctcttcttacacctacatctaggtcttaatttcactcaagtttaacttctgcggaaaagagggagtattcgtatgcttcgtttccggggaaaagatgtcttgcgcatctcaaaatacaatatgcttatgtttatcattctaggtctattaggtctggggataagcgtcggttatttatgccgacacgtccccgctttcaagggattggaacattccatctcttatacgattttcgcgatgttgttcatatttggtattaccataggagccaaccaatctttgctgaataatattggtgagtttggaatacaagcagccatacttgctatttgcggagtattgggaagtctggtagcatcttttatcgcttataaattatttatcaagaaaggaggtctcaatgaaaaataacctaatcgttatcttatgtttcacagcgggaatcttttgcggaacctttgccaacacgactatctccacgtattgcgaaaaactaccgcaattcttgctatacgccctcgttatccaagtaggattgaatctgggagcaaacgccgaattaggaaagatggtaaaggatatccggttttccagtttgttactgccgttctttacgatcatcggcacgttagtattctctgcggcggcaagtttgttattgacctcgtggaatatatatgattgtatggctgtaggaagcggattcgcttattattccttatcctccttgcttatcgtacaactgaaagaggcgtcggcagggatagagatcgcttcgcaacttggggctatcgcgctattggctaatatcatccgggaaatgttagctttattcggggcaccgctgtatgcctctttctttggtaaattcgctccggtatccgtggcgggaatcaattctatggatgtctgccttccggttatcagccggtattccggaaagaatatcgtacctgtggctattattcacgggattatcctcgagatcagcgtgccgttgcttatctcgctcttttgcaagtagaagcaggatttatcctcgatgcccgcgctatagacacaaaagaggatgcgtacattatatcgacgcatcctcttgttcctttatccgtacttcctcctcacggaggtacttacggacctcttaatttattactttagtattaatattaaacggtggccaatgatcacatcgctcatcataagcacgtgcaggctctttatgagggtttgcttgcggatgtggagggtatcacggtgcaccggcaaccggaagggggggactatgacagtaacttttggctaagtacaatcacgctggatgaacatttgagagtgagggggcaggagaatgcctaccaacaggtgataacaggtgccgtaggtggtgccgccggcgtgattcacactgctgggacggctacaacagactgccagccaaatgataatgtggaggctatgcgtatggcgttggatcgagcgggcgtggaggctcgccccgtatggaaaccgatgcataagcaaccggtatacaaagattctccggcgtatgtgaacggagtgagcgaggctatcttcaaggtgggaatgtgtttgcctgccggcccgtatgtaacggatgaggatgtggcctatatcgtggattgtataaagaagaatatttgttacaattgagagcaaatgtactctaatatttttccgaaaaagtttgcgttaagatggtaaatgattatttttgtctttagtaaaataatcattatggatatatctcgcaactatcatttagaagacaaagtagagtacatcattgctttggtaaatgaattcgcaaagacttatgggttgagcgatgctcaagcatggcgttatatgaaacggtatgatggtgtgcggttattggatgagcaatatggttttatgcatacccagtctttctcggatatggtggcggatatggcattgtttatgaatcgtaagggaggaaagttgtgatgattctgtatcacggttcgaatgtttccattgaaaaggttgatttgaataaatgtaagcctttcaaggactttggaagagccttctatttgtcgagtgatctggctcaagcagaggaagtagctaattccagggtggtcttctttgggggacaggcggtggtgacaagatttgagtttgacgattcgttgttgatgtctgatttgttgaagatcaagatgttccattcgtatagtagagattgggctgattttgtttttaagaatagggataaacaaaatgcggaaagtcaatcggagtgggatattgtatatggacctatcgcgaatgatcgggtcggggttcagattcgtaagttccgagatttgacaattagcatgagtgagttcatcgaggctctgaagtatatgaaaggtatcacgtttcaatatgccttttgtagtgaggagtcaatcaaatatctttatagactatgaatgtgtctgaggctgaatttgagtatataaaggaaggtattgccaaggatatggtgatattacttgtgaaagagcatggtatgcagataaccgatgctttggatgctctttatacatcggacacattctgtaaattaagtgacccacggactaagctctatattcaaagtcctcgttatgtcttgcagttcttgctttcagaactggaacgaggaaagatagaggaataagaactgtatttttatcaaatttaatcgggtggatgctaatggtgtttacctgtcttttgttatccctttctcgaaaggaatgggatagcggtattgtgttttagccttgttcgcttaccagcccgtatatggcttatatcgtgattgtataaagaaaaatatactataattattatgaaccttttctctcaattatctacctggtacttttccaaaaaatcgttaccctattggggtattatcttgctggattgttgcttgatcttattttccggcttattggtgtacaccttgaataatggggtgttatcaaccttggatattttggggcacctgctggtcacgctattggtctgcctgatcccttatctgatcggctttcgcctgttccatacctattcggggattatacgttattcctctttcgtggttagtcctatctgaactcaatccatcttaatgtcttttatcaagaataaggaagttgaacgaataaatataagaatatggaaataaagacgataatctcaagtatctgcttgttactgctggcggtctcgtgctcaatggatgatgatgcgctgagggatatagagaaaggacattcggggagtgctgtgatagaggagggagaggttgccctttctatgaaagtttctcttttttctttggagacaaaatccttgtctggtgtagggacattgcctgcttccatggacgaggcaaagattaataattgtacattgattttttttgagggtgggcaagtcaattcgataatggaagggctgtttgtaaatagcgagaattatatcgttaaaaagaaaaacggcacggaagatgactgggcaaaagtaatcgtgaaagtgaaaaagcctagcccttactccgtaatgttaatcgctaatagctctaaatcgtttgcgggttgtcaatcggaaagtgatataaacgatataatacaggataataaggatgctttagttaaagtagggaaaatgaatatcaattttgattccaactttgccggttatgcgacaattagggaagcattggaaaaacctttagaagttggtccagtccctttttctcagctaaccgctcgtatagaacttgcggaatttaatgtttctggttttcaaggagcatctgttcaagagaagattactgttacaggagtggatctgttgaacttgaatcctgagagttatacgacaaatgagcaaactcataaaaatgcgacttataactcagagagtaagacgtgtaatgtggaggtatataatggagcatcagagtttccgtcaacttattcttttgtggagaataaaaatgtattgtctttttactcgttccggaatctggcggcggcagaaagtgatcaagtgaaaatgcaagtccggtttaaggtcggaaatagcgaggaaagaacgacaaggcagtttgtgatcaataaggaggggaatattttgcatggtgtgaaatccggatatgtttatcgcttggttgtcaatatgactattattggagataaggtcgagacagaactactttgctatacaagagattggttgaataataccatatccattcctatggaagataattaaggtgtaaacgggtaaaataaaaatacaagattatgaaaataaggaatatattatcagtgctgtttgtcggactgcttttcacgagctgtaactcggaagaagaagtccagcgaggaaatgaggacgggcgggatatctcattctctatgactcttactttgggagaagtgacagcgatgacgaaagctggaggggatatcgctgaagggtatacatattcgacagaggatgaggtaaaagtgaataatgttgtggtcgctatatttaatgaggcgaatggaactgtgggtgagtgcttggagtacaagtctgtagcgtttgacgggggaattcccaattctaccgtaacgattgatggaaaaacattgattgcttataaaattgataatatacaagcaaagacaggtaaggttcgtatcgtagcgattgcgaattcaacgcattatgaggacttggctagattgggaacgactacttatgagaacctgaaaggtttgtcggaaaccgtttcaggtggaacttttgatgcttcaaatttggtaaaggtcggggagttggctgcgtatgacctaaatacggctgtgacaagtatatctgttccgatgacacaattagcggcacgcatcgatatgaagtttacggtagatgaagagccggagactgtgtctacaacagatgatacaaaagtaaccaaccagtggttctatactgtaactgaacttacggtcaagaatatcaatcagaaatcagatttaatattgcttggtcgagataatcaatatgatgatgctttctctacggcaaaggatattacattgcaaaatggcgttgcgttacctttttatacctatgagaagttgaacacgacgttaaccccattgtctatatatgtaacgggtgatttacaaaagatacaggtcacgactacctttaatgaggatatgactattcaaaatgtaacgaagggaagtattatagaggaagagaaagatcattcttataaatatgaggattttaatcctacgacagcgcttgaaggatgtacgacaaatggtatcatacatggtaatagatatgagcttacaggtaaaatatccatgaagacacaacgaatcaactttacggtatctacaactccgtgggaaggcgtggaaaagtttgtcgtggatgtggttattgcggatttgaagtatttgttcgtgagggagactaaggtggtgatggcgaatatcactgagtataagatagagtttgtctcaagttcagatgtaacagtagagatgcctactaatgctacttatgaagaatattatttggtaaaaggaaagatcacgaagagaacaggtacatattatcctaatagctattatagtaaatggacagacgaaaataggcacaaaaaagatcaatatccagaaattgtagcagtagggaaacaaggctatataactattaaaagctctttacccgtgaattattttccgaaagagtttgtttttgggatttataataatgacggattgaaagtgcctgaaattatagtagatcaatatcccgcacaatatttagaggggaaagtctctgaaacagctggtccagcagatgttcctgacggagatagaaaccctaatatttttacaataactgtcaaagctgcagggaatctgataattggagatcctagtactataaaaaatggagtccgggtgactaaagacgacgctttctctgcggaattagtatctccaaaatttgtagtagcctcaagatttggtgctgtaggtacaggtacttatacatattccaaagcggtagaacgttgtaaaaaatattgggagaggttagaggatggtacctattatgaggctggcacatggagggttcctactttagctgagttagagtttatgaatacagtacaagacgcttctcctgcggtaaactatttgtttaatacaaacggtacttattggtgtgcaatgccgtattggtattatgactttggggcaaataaacgtaatcagtttactaataatgcctctagtcaaaaagctgacggtattcgttgtgtaagagatttatattaaagatgtttattaatgatttaaatagagatttttatgataaagaaattatatagcctgttttccatttttctgttgctcgcttcatgtgcgacagaggaaatagaacaaatagaaattcaaccgacagatggatcaatggtctctctttcgttctctgtagatgctccgaatgctcttgagattacgaaagcgaccggggatgtggagaaaggtgttgagtccttatatctatatacatttaatgaggatggagagtttatctctccagttgtagaagctgttgtttctggcaatggatatacggcttctatctcaaaagagacccgtaccatccattttgtcgccaatgatggaacgttaaccccttccctagaaagcggaatggcctcgttagtgacagataagcaaatcttttggggaaagagaacttttagtgatattcctgcgaaaaatataagcaatagtctggaagctgctggtagtaacaatgttgaactactacgaaactgggctaaaataacgctgaatctctcttcggaggcagctgtgaaattaaaaaatgtttcttatcttatttataatgaatcgcagttggcatctattgggtataaagatgagggaaagttgaatattccaaatcaagatttttatgcgccccagaatgagccagatgctagtaaatatgcgaagccgggtgaatctgtgtatacttttgaacattataatcaagataagaaagcgacttttgttattattaaggcgcaatttgatggtagcgagacctatacatattataagattgatcttgccgtaaaggatgagaatgataaggtaactcgtgtttatgatgtcgttcgtaattatgcctttaatataacggttaagagcgtttccagaaaaggagctacgtgggctgaggttatagatgaaaatgtgatagcggataataatatcacggcctcggctattatggaaaagtacccgaatataacttatgatggtgaggccttgaatgttacaaagacgacattcgtttttacgggggcttctaacacattgtcgatgactgcgacatatgcgggagcagggcagttgagtgtggttccggatgagggaatgtcggatgtcgtagaaggaaacttaagttatccttcttggataccttctggcaatcagacgataacgattacagccaatataaagccggctcctggctccggtgagaagatagcgtatttctacgtggtaggaggtaatttgcagcgtaagattaaattggtcttacgtcccccttataactttatcaatccgagatttgaaaatgtaaaagctggtgccggaacaaatgtgattaatggaggcctgaaacaagatgtttatctgaaattctcgataccggaagatattgatgaatcattattccctattgagtataagatatatactaaaaaactatatgcggtagaacccggtgttcgtttggaaacaacaggagcgaaggattggtgttatgtatatacggatcaagtctttagcaaagatgagaaggttatccattttaagacgaatacggctaatgaaggagaaggtatgggggataatgacaaagtgtttttaaaggcagatctgtttaatgcgtttagtgctttaacttattcacgaaaagctccaacaaccatatctcctactattgctggaaatgttatagggggaagcagttcttggaatggatatactgttcgctataaaataaataatataggttcggagaattcttttaaatgtggaagtgggggggcttactctattgcgttgaagaatgttttgtctacagatgttgtttatttttattattcaggaaatagctattggtcttgtcagaagtccgtaagccacttgatagaggatggtaatatagtgatgagtagataattaagtacaatcagggttcccatccatcatgtgaatgacggatgcggggagcgtgcagcacacaatggattgaatttgttttacacgtaggctgcacctcctccccggccctttacctcatatagcattcgtgctttatcgatgccattcattccgtaaggagatgggggcatcgctttcttcatttgccgatgacgttaacttacttgccccatgcagttaacttgctttggtctgatatcaaaggttcttgtgtaaaaaattgcgcaaccctttgtttattaaaaaaaaggctctatctttgcagcccgaataagtatgcgaataataataaataatatagaaagatgaaaagaacattccaaccttccaacagaaaaagaaagaacaagcatggcttccgttcaagaatggctaccgctaatggccgtagagtattagcttctcgtcgtgctaaaggcagagctaaattaacggtatctgacgaatacaacggataattagtcacgttctaaagatttataaagaaagtagaggttttttcctaaaaagcctttactttctttgtttttgtagtattgctctggtggatattggtctatatgccgttttttttctacttttgaaccgcctacaaatacatacgtgaaatgagtaacttttttgtaaaactgataaagaatccgtttgtcatcaatctcttgttggtgatagtcgtgtcgtgcggcgttgtttatggcgtgctggcgtggctggattcttatacccgccataatcaagcggtggtcgttccggacgtgaaaggaatgaagctagaggacgccgccgagtttttcgggaataataagctacgctataacgtgatcgattccgtattctcgaaagatgtggctccgggctccatcgtggagttggttcccggtgtcggatcgaaggtgaaagaggggcggatcgtctttgttacgattaacgcgttgacctcccagatggccgtgataccggaggtggaagacttatctttccgtcaggcgtatgccttgctgcgggcccgtggcttctcgtcggtcgagatagagtatgtgccgggcgattataaagatttggcgatgggggtggagttaaacgggcgtaccttgctcaaaggggaacatgtaccgttgaccgctcatctggtattgaaagtaagcagtggcgatccgaatatgcttcccgactcattggctttggatagtattccggtagaaccattggatagtgatatagaaaactggttttaagggaatggacgagtttttggacgatatggatgatgaacaggtagacgacctgttgatgccggaagaagacgaaacatcgtcgagccagatgtatgagcatttccgtttcgtagcggacaaggggcaatccctgctccgggtggataagttcttggtagaccgtatgatgggcgctacccgtaaccgcatccaattggcggctgaggcgggttgtatcttggtgaacgataagccggtgaaaagtaattaccgggtgaaacctttggatgtggtttctatcgtgatggatcgcccacgccgggaactggagattatccccgaagatatccctttgaatatagtatatgaggacgatgatttgctggtggtgaataagccggcaggcttggtcgtacatcccggtcacggtaattataccggtacgttggtgaatgccttggcttattatttgaaggatgatccctattatgatccttccgatcctcgtttaggcttggtacaccgtatcgataaggatacgtcgggcttattggtggtggctaaacgcccggaggccaagagtaacctaagcctgcagttcttcaacaagacaaccaaacgtaaataccgtgccttggtatggggcatcgttcaagaggatgaggggcgtatcgagggaaatatcggtcgtgatcctcgtgaccgtatgcaaatgaccgtcttcccggaaggcgatcaaggcaagactgccgtcacccattacaccgtgttggaacgtttgggctacgtgagcttggtggagtgtcgtctggagacggggcgcacgcaccagatccgtgtacatatgaaatatatcggtcatacacttttcaacgatgagcggtatggcggacatgatatcttgaaaggaacaacttttactaaatataaacagttcgtgcaaaactgtttcgctatttgtccacgtcaggccttgcatgctaagacgttggggttcgttcatcctactacgggagaggagatgtttttcgattccgagattccttccgatatgcagcagctgatcgacagatggcgtgtatacgcgaacactaaagaactataaaaatgaaaaagaacatcgctatcgtagcagggggagattcctccgagatcgttatttcattaaaaagtgcggacggaatctactcttttattgataaagacaaatataatttatatattgccatcgttaagagggatgagtgggcggttatacttcctagcggggaacatacaccaattgataagaatgattttagcttcaaggagaatggcgtgacgaggcattttgacttcgcttatataacgatacacggtactccgggcgaggacggacgtttacaaggatatttcgatatgatcggtatgccttactcgtcttgcgggatgctggtgagcgctttgacattcaataaatacgtatgtaatcattacttgaaagactttggtgtaaaaattgccgcatccattcatttattcaagggagagactattacggacgaagaagtcgtgactcgtttgggtttgcctattttcgtgaaaccaaacgatgggggtagtagttttggcgtgacgaaggtgaaagagctctccgctatccagcccgctatcgctaaggcgtttggggaaggacgtgaggtgattctcgagagctttatcgatggaacggaagtgacatgcggttgctataaggtggagggtaaagaggttgtatttcctttgaccgaggtggttacggataacgaattcttcgatttcgacgcaaagtataacgggcaggtggacgagatcactccggcccgtatctccgccgagttgacggagttgatacagcgcaagacatcaaggatctacgatatattgggcgccaaaggactgattcgtgtggattatattattccggcagacggggagcctgtcttactggaaataaacacgacaccgggaatgacggctaccagctttatcccacagcaagtatgtgcggcgggattggatataaaggatgtcatgacagacattattgaagacgaactcaaaaacagaaaaacaaaatgaatagatatggatacagaaacagtttcccctaatttcgacgacatccgtccgctgaacaacagtgaggtgaaggacgcgattgaaaaattggtcgccaatgaggatttcgagcgggctttacgttacataaagccgaatttgaattgggaggaattctcagttgccatgcgtgcttgcaagacgaaggaggagtttaaatctactctggcctatgacgctgtaatgacggtggcgaaaaatactactttctcgcttactatctcagggcgtagccgtctgccgaaagataaggcggcctgtacgtttatctcgaatcatagggatatcgtattggatgcctccttcttgaacgtcatgttatatgatgtggggtatggtatgacgcaggtcgctatcggcgacaatcttttaatccgtccgtggatcgagacgttggtgcgcttgaataacagctttatcgtgaagcgtggcgtttctgttcgtcagatgttggaggtcagcaagacgctttccgcctatatccatcatgcgatcaagaatgtgaacgagtctgtatggatcgcccagcgtgagggacgtgctaaggactcggacgatcgtacgcagggtagcgtattgaagatgttgagtatcggcggcgataaggataatctgttgttgaatttgatggacttgaatatcgtaccggtcgctatctcctacgagtttgatccttgcgatttcttgaaggcgaaagaattccagatgaagcgggatgatccggattacgtgaaatgtcagcgggatgatttgttgagcatggaaacgggtatcctgaataataagggtcgtgtccacttcacgatcacttccccgatcaatgattccttggctaaactggacaaggatatggagaagaatgagctggtaagcgctatcgcgtccgttattgaccgggagatctataagaactatcgtttctatccgtgcaattacgtggcgtatgacttactgaactgcactcgtcgtttccaagaacattatggtccgaaggataagaagcaattcgaggaatacttgcaaggacaattggataagatcgtccttccgaacaaggatgaggcgttcttacgtaagaagatcttagagatgtactccaatccgctgaaaaattatctgacaactttataagcggcctttatcggctatgcgtagcggttcgtacttgatccgcccttgatcccctctttccggcgagcatgccaccttcgggtggcagccgccggaaaggagggattatcttttttgcaggaattcgtccaaggattcctctttcagcaatccaagtttcttgcggatacggctgcgtccggagttgacgctgggacgggagatgcccaaggccaacgagatctcgtccgtgctctgcttcaggtagatcagcatgcagagcagttcgtcggatttggtcagttccgggaagtccttacgcaagccgggcaggaagcgagggtacagggcggcgaaggattggcggaaccgcaactcgtcctcgccgctcagcaaggaggggttgagcttctggcgtacgctgtcgatcacctcgttatgggcggcttgctccagctcggcgctcagtcgctcattgcggcggttcagttcttgttgggtagcgaggagattatccagtcgttgacgctggatctcccgctcacgttggtgaagccggcgacgttggagtgcgtagacaatgatcccggtcagcaggcaaatggctaggatcaggatgacgcgcgtataaacgagcgaacgttccttcaaggccacttcggcggataaggcccgattctcctgctccttccgtccggtctcgtagcgtacgttggcaccaatggcgtaccgctgtttctccgccagttgcaacgagtcgtgtatctccttgtattccgggtagatctcggccatcttgtctcccttcttttgttgggcgtaaaggttgagcaaatgccgtccggtccaatccatcatatcgttcgcctcgtatttcttgtagagagcgtaggcctcttccatcagggggaagcctttttccggctttccgtcgcgtacgaggcaggcccccagcatgaatttgaaaagatcttgataccccgcggagatcgcttcttcctcttctatcaattccttgtacccttcgagggcggcagggatagagtcgggcacatattcgtagtaataattgtaaagtatgtttttggcggcgaggacataggcgttctctttcagctcctcccctctctttaaggcctgccgtgcgtaatataaggtagagtcgtgctgttccagctcccagaatatcccggctttcatccggtagaggtcgctgatggtaaaactatccaactggagggagtagtcgatggagcgtgagatggcctccatagccttgtcgtacaatccgaggtcgctataggtggaggagaggtcggcgaaggtgtagacgaaaccccggttgagcttctcggggtgggctacgcaccagtccatggcttcctgtatgacttccacctctttttcccgcattcccttgcggcggtaataatggccgagggtagagagcaggtcggccggatcgtcggcggcatcggggtggaggcgatagacggcgagggccctttcttgcacacggatcgcatccgaagggtcgcggcggaatttatagagcgtgttggctaccgcttgggtgatacggatctctagccacgggtcgtcggaagggggaagagcggcgaggctgtcggcgaggcgcaaggcctcctcccggttgtcgcggtcgttgagctgccggagtatctccttggtatcgggcggaagctgccgggagagggagccgtccgcgggaggcgtgtcgtgccggcaagcgagggtggctagcgagaggagggtggctagcaggaaatgcgtgatgtctctcatctgcgtaggattttatggtttatcgcgaatatacgccgtttttcatggaaaatagcgtgtcccggggtataaatcgattgaatcatctattggttttttatccgtccgaaggcccggcggcgtacctttgacttgtccgtaccaccggtgccccgagcggcgtgtcaattaaattgatgatcgcatttcgtgcggataaggccgttgttgaggacttgttgagcggattgctcaaaaaagaattcgttgtataaggataggaatggtttcctttgagaaacaaaaacgaagtagtaatggaagggtcatacttacggattttgatgatgtgcgggatgctggcgctcctcctctgcgggggctgctgggtgttcgcatggaagcatctgcgccggcggatcgacgagcggttcgacgtactgtcggaacacttggagcgtcacgccgccgagtgcccgatacggaaggagcacctgctggcctcgtgccttcccgccgatccggagcgaaaagggaacggatcgttccaccgatcgttccgggcatcgtatccgggtttcctgccgacgcttagggagcgggtgccggggatcacgccggcggaggaaacgctttgcatgctgatcaagatgaacctgagcaaccgggagatcgccgacaagatgtctatctccatcggaagcttgcacaccacccgctaccggctgaaacagaagatgccgccggaggccgccaagggcatggacgaatgggtacgggcgatcgaatagggtcatggggaggcgaactccctacattataatatagagtatacacctttatctaagaagaatcagtatgagaagagaatctttatttttcggtattttgacgctggtggtgtcggccttcctcacgggatgttccgacgacgacacggaagtgtacgtcccccagcgtgtggcggagttcaacctctccgacgagtcggacggcaaccggctgttcatcatccatccgtgggagggcgagatcgccatcccggtgcacgatgatcgtatccgcgacttcgagttcagcggcaagtatttcgattgggagatgaggcagggggccgagagccgcttcctcgtgctcaacctcaagaaggaggtggagcgtaagcctttcctcgagaagatcgccctgcgggggatcgccagcaagtcgggggaggcggcgacggacacgctcttcctcgtgtcgcaacccaagctggaaagctcagcgtcggataacgccccgagctatatgcacaacgtgggcaagacggtgaacacggcgggcgatatcttcgccgcccctagcgagcctttcctagatttcgacctgatgtacggcacggaggctttcgtgaagaccccccacgccgagtcgtggggacgggaacgctccggcgtggactacgaggagatggtggacaacatgtggcaggagctcggcatctcggtgagcagcctcggcttcacgaaccaaggcgctcctacgcctacgaggtcgaaactcttctccggctccttcgaccagcggttccagcataaccagacctcgtccaaccgcttcgagtatcacgtggacgtgcatgtcaagccgatggtggagctgcatatggccaccgccatctatacctccgccagcaatcccgacgtcttcctgccgttcctcaccacgaccgcctcgcgcttgctgaacgaaaccaatagcgacctctacaagcgatacggcaacacgcagaagggcatctacgatctatacgacacctacggcacccacgtgctggtgggcggtgtcttcggcgggagctatacctatatctacagccggaaggagaacctctattacaacgagacggtgttcgccgccgaggcggagctttccgccaagtcgtcgtcgccggcgggagagaacgagaactggctccagacctactaccgcgtgatgggtacccacggcggcaagatcggcgccgggggcggctatacgaagtcggagctgaacgagcatatgtccgaggagagcatcatgatcatcaccggcggcaacgcctccgtggacttcgagagctgggacaagtccatcgccgacgagaacagcaacctccacctcgtaagctacggcccgaggggcgataccacccgttgcttcctggtccccctgtattacctgacgaagaactacgcgcggcaagatgcgctgaagaaatatctggactcctacgtggaggcgcattcgaagctggccaagaaaccgcagctgatcctggccgacttcatgatgcgtaccgggaaggacaatcacggggatcccgccggacaacgtgtcttcaccgggccggacggcaaggaacgcatctacagcccgctggtgctgaataccaagggaccgaacgactcgcggatcggcaagatgctcgatacctcggcccacgagtacctcgacgtgggggataacgccgaccagctctggtgggtagccctcgacttcaaggacgagtgccgccccatctaccacatgcgcttcatgaaggaggacgacgcccgcaagcacggcttcgaaccgcgggggcaggatgccgaatcgggaatgatgtgggacgcgatcgataaccattacgtttgcttgaagttctcgcccgacgacagccataaggaaccggtcaccggcgtgggcatcgcccgcaaggggaagagcgatgacctatactacgtgatcgccacctcgcccggtaccgacatgacgcttccttactccatcgacgagcaattcccggcctattggggaagcaaggagtataaattgaagagcgagaacccgccgtaccgcttcggggtggaccaagagaacgacttgaacgagggagacagttggttcggccgcaacaaagccaccaaccatgagcaatggatcttcccggtctacaccaccaagccgttggattggccgatccggtttacgaaagcgacggactagcgaaatacctcggaaacgatccctacgaccgtagccatccctcccgaggcctccggaacgatccccacgaccgtaacggccctttccggggcctcgggagcgatttcgacgcccgtaggcgttattcgatagataaattgatgattatcaaaggtattatcctgtatttgtaggaaaccttacgtctgagaacaagaggaaagtattaacgaaaaaacaacaaacagtatgagtttagcgaaacaaatcggatcggtagcgaagaccgcgttgaccaacgccggccacatgagtatgaacaacgagatctacgcccgtatcttggatacgaccgtggccgccctccatctggaggccctcgctccgggttacaaggaatgcatcgaccgggaggcagagtgcgtgaaccgcgtcaccaagagcgcctccaccgcccatctggaggcgaaagacaaggagcgcaacaagaccctccgcctcgagcctaccgaggccatcaacgccttcatcgacaccgtgaaccagatcttccgcaagtataagaacctcatcgccgccaagggaggtcccaccagcccctccaagcccgacgacaagccttatcccacgcccgaccctacgcccgaacccgagaaccccggcggcgatagcgagagcccggatgagatctgatcccaatgaattatcgaacacttaaaaacgaatccatcatgaataaaacgtatctttctagaaagatatccgtgcggctctccctccgggccgccgcacggatgatctgttgtatcctgacgctggccctctgggggccggcacgtgcgggagcgcaagcgcagtcacagccgctaagcgtgaatacgattagcggtaaactagccctcacctataaactgaaaaacggcagtcagaccgattacgcttggttttacaagatcgggactaatggcaccgacaccgagttctccggtacgctgacgggcacgaacgcaaactggcagcagggcgcgatcaatatcaaaagcgagaaagcgatagccgacgcgaataatcttgacagctacccgatcctaaaattggatgggctaaacctgacctccactactgccgacggctcattattttatctggagggcagtaaaccgttctgtatccaagcgacaggcaactctgccagtaacctgaaagcgaaaaaggatgtgattaataactaccaaggatgcatcctgcttctggatggtggcaccgccggattgaatatcgccgcggaaggaactggatcatatggaatatatctgtactctactagttctgctataaataccaccatcaaaggcaagataactgtcacggcggaagctgttgctgtgtttctagacaattggggtgctttctcggctaccgaagacgcgaaagtaacggtttcttcggaagataaagatggagacgcaatttatggaagctctagagtgaaatcccccttcctccaatggcagttcgccaccgccccaacgagtggccagacgctcgaggtgaaagacgccagcggccaatcgttcgatcccgttatccaattcaccaccgacggtaaaaagaagggtttcgccatcaacgtcacaaagaacaccggctacaccctttggctgggcaacgaacaactgatggattcgaaaggaacaaccgtctttacggcaacggaagataaattagtctccttctcaggcatgacgactctccccgccgactggcccgagtacgccaaattagccaatgtcggcccgactggcaccgatgtcgccgtctccggcactacctacaccgtcaagaccgcctgcggcctcgcgtggatcgcttgggtgacgaataacgggaagacaatcgccgatgccgataaaacctattccgcttcctatcccgcctccgagggcttcaaggactgtacggttacgcttgcggacgatatctcgctggcgaaacctgcccaaggcgtggcgagcggcttcgaggctaattggataccgatagggacttataaaggcttcgatgcacgttactactttcaaggcaccttcgatggtggcggccatacgattaccggaatgacgatctcctcggcctcgttttactatatcggccttttcggttatctgtatggagcgaccgtgcggaatctgacgatggcaggatctgacaatattaatttgacaactattgctaatgctcaagacaccgcttactatcttggctgcgtggcaggttatgtaaagaatggaaaaatcatcaattgccataatcaatgcaaggttagtttttctgtgaccggcaattctgggtctctcggtggaattgccggttactctgaaggttcggtgattagcgcttgttcaaacaggggagctgtcactatgaccggaaagatgggtcgtggtggtggaatcgtagcgactaataatggctcttctatcgtttcctgcttcaatacggaggatatccgtgttactgctaccggttctggttctagcgatgccgcgtatgcgggcggtatcggagcctatagtagcggtaattgtagcgtatcgcactgctattcgacagggtggataatcgctaaatcttccgctgctaatgcttattccggcggcatattaatcttaaatttattaattatggctaatcagatagggagttccggtagaacgaaggtaattgaggcattcgttctgtatagccctgtataaataagcgtttaaagacgtgtgaatatcgatgttctcacgcttttcccagaagcggaggaagacgttttgtaagatgtcttttgcgtcttccgggtcggggataaattttcggcaatgtatataaagttggagataaacagacttgaacagggtattaaaggcggctatatctccttgtttgatcaattcgattattttgttgtcagatgccattttattcccgtgtattattagaaaggtggagcgtataggcaaggagaacattccttgggcctatacgcttactgcctgtcaattaatgctaaccctattataagatttcgtttgcggttttattgaaatattggatacattctttaatatccggtactgagttttcccagttgtattcatactcgatagagaatactcccttgaaattctgggatttgagttctttcaacatttcctttacatctaggatgcctgtgccccagatcacgtcgtgctgctcattctctcctgcttttttcggggcgatatccttgaaatgcaaagagatgattcgacctttgagttgctttaagcaatcaatctggtttagcccctcccgacgccaatgccccacatctgaacaagaacctagcaagtggctgcgtccggaaatggctttcaacaagttctccggtttccaatactcggaaggctgcgggtgattatggacggagatcttaatgttgtattgcttggacaatttttctaccaggtcccaatcgcttaaagccggttcgcaagtaatgaactctaggtccatcgctttcgcgaatttgaacatcttttcccaatcggacgacttttcggctacatacaccccggttcctacgatcttgatacctttggatgccgcaagctccttgatctctttctgagtttgtgcatcgaggttaaaatcgaatactttatctccccatttaccaccgagcttatggccgggataaatctcgatgtatttcaatcccagttcttgtgtcttatcgagagcttccgtcaaagggaacaggtggaaactataggattgcatccctagacgccatccgttcttctcggccttcgtttgcgcttcggttggaatagccaataggcagcaaacgatcgctatcattattttatagatatgtcttatcatattcggttgttattaaaaggtttatcttggcatatccggcagagagaaaccgttgttatacgtctgcttgatccattcgttggccatctccgcagcgttaaactcggcgaagcgacggtcgaaacgcggatctccgtcaattaccttgaaatcatccaccgtgacgatcttgatcttatcgttcggggagatgttcgtaaaccgcatattctctccatcccattgcaactcacgatgcaaaccttgcagtccggagaggcgaacggccaagactcccatcacgaccatctcgttgaacggaccggagaattggaagttggatgaggcttccgtacgattttccggggattccttacatgcacggatccagtcttgctcatgggcgttggtagaccatatgtctccattgccacctttcactctcgggatcgtcggtttgggctggttgaaatgttccatgtcggaaaccggtaataaggtcgggttcattccgtaacagcctgtcatgatctttcctttcgttccgatgaagatgataccgccgttctcgtcgcccatcatctgcccgtctttcaattcttccggacggggaggcatcaagcctccatcgtaccaatagacttttacttccggcatcttgacatttcctttgggcggacgtgcggggaatgtatacgttacgatctgtgcgtgaggaggggagtacagattactcaaagtcgagctgccgattacgctggtcggatattttaagtcgagtgcccaatacaacgggtccatgatatggcaagccatatcgcccaaggccccggttccgaagtcccaccatccacgccagttccaaggggtatagaccggattataaggccgcttttgagccgggccgatccataaatcccaatccagtgtcttcgggcacttcggggtatcgttcggcttcatcaagccttggggccagatggggcggtctgtccaacaatgtacctcatatacatcgccgattacgccagactgtatccactccgcgatctgccggcaccagtcgaatgagttaccttggttacccatttgggtggctaccttatatttcttcgccagtttggtaagcaaacgcgattcgtaaacggagtgggtaagcggtttttgcgtatagcaatgcttgcctagcgtgattgcgtgggcggtcacgccggcatgtgtatggtctggggtggctaccataatcgcgtcgatggacttacccatctcatcgaacatgacacgccagtctttaaagcgtttagccttcggatagtccttgaaggtcttgtccgcatagtgccaatctacatcgcataaagctacgatattctccgtgttcatgttggcgaggttacgacgtcccataccgccgacaccgatacccgcgatattcagtttgtcactaggagctgtatagccaaaggatttaccgagcacggaacccggaacgatcgttagtccggctgccgctacggctccggtcttgaggaaacttcttctcgaaatgtttttcataactattaaattttaagaaaacgataattctataatgtttgtaaatgaaggttgcgccaaagaaccttgatgccgccaccatcatgtatttgtaacgcgatacgcccttgaccggctccgatcttttcatcccggatgtttaccatctcctctccgttgagccaagtctgtacattatctccttgtacccggatacgcatcgtgttccactctccttgttttaggatgttctccttctcgtccgggatctgtatcaaccatcctcgtccgtaggattcgtagataccgcccgtgtcaaagcctttgggggcgacttccacttgccagccgtttacctttacatctttttcttctacaaaggaacgaataaatacgccagaattaccatccgcttcctgtttaaattccacggaaaggtcaaaatcgtcgtaatattcccgggtggctagatagccgtattgtttatccgggccactttcgcatattaataaaccatcttttacataccataattctgtgccgtatttatcccagttcgtaatgtcctcgccgttgaataaacgagcctctcgtgtcttgcggggaagttccttgatcttgatattacggaaccatgcgggataaccgtggtcttgcaaacaaatcaagcctttatgcgctaatccgtattcaggagcgttcgcccatttaccgctgttcttacgggagaaccaatcatcagaccatgcatcgaactctacggttttgtgcccgttcataaagtaggtgacatgtccgttgtcaaaaataatcttagagttgttccattcgccggccggatgtacttttatcgtgttgaagtccggtaaatacatcgcgtaatccactccgcaacgttgccaatcttccaatggctccgcgaaattgatatcatcaatcaattgatactcggggccggtaacgtagggaaccgggaattgaggacgttctaccacatgatataataaaccgctatttcctcctttcgagattttccagtcccacgaaagctcaaaattctcataagccttgtcggtgacgatgtatccgctggcatcgctaccttgcccgtccgcttggatggttccgtttacaacttcccaaggtccggtcaaggcggttccgttataatcccgccagccatccaaggtttccccatcgaatagaagttcccaaccttccgctttctcttgttcggtcaatgtgttatgcttcgtgttatcacaggcgattaaaccgaaagcagctgtcattacgaacgatacgattgttattttcatgtacgtatagctttattgttaatacaaatttgtcggtgttttatatatgagacaactctggggcaagggatacgtaagctctttttccttttttatttattttaacggaagtgtatggcaatcggtcatttattagtcggcaaacgcagtagtactgactttgccaagtaatatatactaacatcgccaacgcagtatatctgatttggatacactaaatacattatatgatgtagccaaatgttgctgtaatagttatggtatcaacgactgaagcttttctttacagaaaatactacaataagccagtaatcgaatactttatttaaagtgttgataatcaatattgtgaaaatatcatgatgtttatgctgaaacacgtacgtgttttcgaaaaaagtcgtacatgtttaaaaaaattcatgtacgtgtttttctataaaatgatagggatacaactatacatgtttaaaagttacaataactctactttacagggctttgtcataaaagatatcgctgacaattatcgagtgagtaagaaaaggttgaaatgtgatagcaaaaggcgttggggtaccatgaaaatttactaccaccattctatatgtacactgtaagtccgtataatatatggaatagcggtagtaattgtaacaaacgagagtaaaaacgtccgttgtttttgctggatttatttgatttgcttaaacgcttttccgagcatatccgtgatgtcgctggcgatcatgctctcttccgagcggaaagcggcggcgagatcaccggctgtgccgtgcaagaatactccgactacagcggcagtttccggagaatagtcttgcgccaataagccgaggatgatacccgtcagcacgtctccgctaccggcggttgccatgcccggatttccgcaactattgaaataaatgtttcctgccggagaacaaatagcggtataagctcctttcaatacgatacaaatcttatgttcggcggcgaaagattgcgctttcatcaaacggtcgtatgagttcgtgctttcacccgctatccggtcgaactccttcggatggggagtgaggatgctccgtggcgggatcttattgaataagtccttgttggatgccattatattaatagcgtccgcatcgataacgactggttttgtgctagattgcaggatacgttcgatcgctgctgcggattctaaatgctgtccgagtcccggtcccataccaacagcggagtaactacctatctcgggaaccgtagagaaataatcaggatttgcgtctagacttaacatcgcttccgggaaagcggtctggaagattgattcgcctcgggtcgggatatgcacggtcaatagtccggctccactccgtaagcatgccttcgcggataatagggcggctcccatttttcctttacttccggcgatcaataaagcatgtccgaacgttcccttatgggcgaaacgtttgcgagactttaacgaataggatatatcttcttccgtaaccaatgagtaaggggaagccgtctcataaattgcgtccggatggattccgatatccagtattttccactcgcctacgtattgctcattctccggaaaaagaaacgccagtttcgggaagccgaatgtcaaggttaagctggccttgatgatcgcctccgagtcattcttacgattatcttccccgaataagccggaaggaatatcgatcgctacgacttccgcctcggattggttgatataattgaccatagcggcgaaacctccggtgagaggacggtttaatcccgaaccgaacaagccatcgatcaccacgtctcggtcggttagcgtcggcggctcaaagtcacggaccacttccgtaaattcgatccgttccatgtcgagcagacgctgcttgttttgctcacactctacggacagatgctccgtcgggttgaataaatacgtctctacccggtatgattcctcgttcaaaaggcgggcgatggccaaagcgtcggctccgttattgccttgaccggcgaaaatcacgatgcggacctgcttggagtagcgccggcaaaactcatggacgaacgtcgtagcggcacgctccactaagtcgatcgaactaattggctcgtgttgaatcgtatattggtcgagctcctttaccttgtctgtagcgaatatcttaatcataattctagatgtctggggttttattctgcttacaaatgtataacaaactttggtatgttgctacacttttttgtgcatcgccgaaaaagttgtacatttgtcccctcgaaaaccgaaagatttatggacagaattcgtctaaaagacaaagaatttgaactgtttattccggagtcggatattcaggcggctatcgctaaaatggccgttcagattaaagcggatgtggaagggaaaaatcctctattcgtgggtgtgctaaacggggcttttatgtttgtcgccgagctgatgcgtgagctggatgttccgtatgagctgacattcgctcgttattcctcgtatcaaggaacttccagtacgggcatattgaatgagatcatgccggtgcaggctgatattcgcggacgtatggtgatcttattggaggatattatcgatacgggctttacgatgagctacgtgatggagaagcttcggagcgagggtgccgccgatgtaagattggcaacgatgcttttcaagccggaatccttgaaatgcgagttgactccggattatgtaggcttacagatacccgctgattttatcgtgggacatggtttggattatgatgagttgggccgctcatataaggatatctacaaggttgtggaataaaatagtatacattatatataataaaggaacaatagtatgttgaacgtggttatttttggtgctcccggttcaggtaagggaacacaaagtgagttgattattaaagaatacggtttggatcatatctctactggcgatgtattgcgtggcgagatgaaggctgagactgaactgggcaagatcgctaaggattatatcgagaagggacaattggttccggacgagttgatcgttgatatgttggcgaatgtattggatagcaagaagccggctaagggcgtaatcttcgatggtttccctcgtacgatccctcaagcgaaagccttgaagaagatgttgaacgagcgtggaacagacgtttccgttatgttgaaccttcaagtagaggaagaggagttgatcaagcgtttattggagcgcggtaaagtatccggacgttctgacgataacttggagacgatcaaatccagactggatgtttaccatactcaaacagctcctttggcagactactatgtaggtgaaggcaagcacgtagccatcaaagggatgggaacaatcgaggaaatcttcggtcgtatcaaagaggcggttaataacgtaaaataattgaaataaaccaatatggctgaatcgaactttgtagattatgtcaagatctattgccgctcaggaaagggtggaagagggtcttctcacttccgtcgtgagaaatacattccgaaaggaggtcccgacgggggcgatggagggagaggaggtcatgtgtatctccgtggtaaccggaattactggacgctccttcacttgaaatatgaacgtcatatcatggccaccaatggtgagagtggtagcgcgaagcgtagctcgggtaaagacggggaggatcgagtaatcgaggttccttgcggtacggttgtttacgatgctgagaccggagagtttatttgcgacgttacggaagatggtcagcaagtgatgttgctgaaaggcggtcgtggcggtctggggaattttaacttcaagacggctaccaatcaagcgccccgttattcgcaaccgggtgagccggcattggaacgtacggtgattcttcagttgaaattgctggccgatgtcggtttggtaggcttcccgaatgcgggtaaatctaccttgctttctgtcgtatccgccgctaaaccgaagatcgctaattatccttttactacgttggagcctaatttaggcatcgtgagttatcgcgataaccgttcgttcgtaatggccgatataccgggtattatcgaaggagcaagcgagggaaaaggtttgggacttcgtttcttacgtcatatcgaacgtaattcattgttattgttcatggttcccgctgaggcagacgatatcaagaaagaatatgagatcttgcataatgagttagtgaagtataatccggaattgctggataaacgtcgtgtactggcgatcaccaagagcgatatgctggatgaggaattgatcgaggctttgtcgcaagacttgccggagggaattccgtatgtctttatatcttctatcacgggactgggtattgtcgagttgaaagaccttttatggaaagagctgaataaggagaatttccatgaggctgagcgaattgtccataagaatatagatgtaagcacgttggaatttgaggacgacaacgaatacatcttccccgtggatgaggacgaggatgacccggatgaggtatacgaggaatactgggacgatgatgaagatgaagatacaagaaaataagcaaatagaggtgtcgcggttctccgggttaagcggataccgcgacatttctcattttacgacaacacgtcatggcggcgtgagtacgggaacgtacgcttcgatgaatccgggcgtttataccgaggatgatccgggcttcatccggaagaacttggaacttctttcggatgcggtcgggatttccctagagaatatggttatacctcatcagacccatgaggatcgagtattggcgatcgacgcgtctttcctttcgctgaatgataaagagcgaaagctacgtttggaaggcgtggacgctttggtgacgaatgttccggatgtatgtgtagccgtatctacggcggattgtgtccctgtcttgttatatgcgccggatcgtaaagtggtagctgccgtccatgcgggttggcggggtacggttttacacatagctcgtaaggcggcaagcttgatgatcgaggcatacgattgcgatcctactcaattggttgccggaataggtccctctatcagtcaagcggcatttgaggtgggagaggaagtcgtaaaagcttttcaaatggcgggcttcccaatggagcggattcttcgacgtaatgcggagactcaaaaagcgcatatcgatctatgggaaaccaaccgtttacaattgttagaggcaggattgctctccgggcatatagagatcgctggcatctgtacttatattcggtatgaggattatttctccgctcgtcgcctcagtgtcaaaagcggccggatccttaccgggatatgcttgaaaaaatcttagttatattggctcaaacttataatagacatgatttcaatcactctttcatctgagatatcggaggcttgccccgatcttcacgtgttggctatcgcctgccaagtaaagaacacggagcccgatgaacgactttgggaagaaataacccgtgttgaggaggacatccgttctacctgtaagatagaggatattaataagtggactcctattttcgctacccgtcaggcttataaacgtctggggaaagacccgaatcggtatcgcccttccgccgaggcgttaagacggcggatacttcgcgggcttcctttatataagatagataccttggtggatatcgtcaatctggtttctatccgtagcggttattctatcggaggatttgacgcggataagattgtaggcggattggaactaggtgtcggaaaagagggggaaatttatcacggtatcggacgtggtgaattgaatatcgccggtcttccagtctacagggatggagtagcgggtgtcggaacgcctaccagcgatgaggaacgtaccaagattgaaatgtcgaccacttcattgttaatgattctgaatggttattccggtaaggagggcttattggaagcgggtggttactcggttgacttattaaaaagatatgtctcagcggtaaacgtggaagcggaactgatatgccgagaaaacagaggaaaaataacgttataaccgtgttaatattgtttacaaagcgaaaaatgtccatcttttatgctaaaaaacatctataatcttttgttttaatcatttaatctataaatttgtccccagtaatcaaatgttatcataaaatgattgaattaattggtacaaacgccggccttgtatggaacgttttaaatgaaggcggtaaaatgagttttaaggcagtgaagaaagccacgaagattaaagcggaaaaagatatgtacgccgcttttggttggttggcgaaagaaggtaaattagctttcgaggagattgaaggtgaaatgtatgtttctttagtgtaaacaagaggaacgtttacaagaattagggagggctgttcgatttttttggacggcctttttatttgtccatacgttttctgtcaaaataattaagtctacagttggttaattcaattcaaaaacttacttttgtgtagaatttggtgtgaaatgaccgaagatcataagagattgttagctgtatttgaggttagagttcgtgatttgatggcgttatgcgatcagcagaaacgtagaattgacgaacttacagctgctttgagccttaaagacgaggagttgcggcaggcgaaggatatgattgaaggattgaatgccaaatgtgataacatgctgacggcgcgaattgtttccacgaacgaggaagagatgaagaacgcccggatgcggttatcaaaattagtgcgggaagtagacaagtgcatcgcacttttaaatgaatagaagcgatggacgaagaatttcttataaatatagtgatagccggaaagaaatatccgcttacgatcaaacgtcatgaggaagagttggcacgtgccgccgctgatcagatcaacagcaagattcttcaatacaggcagcatttcgcggtcgaggtggatacgaaagatttgttagccatggtggcttttcaactctcgatgcataatctggagttggaaaaacggaatgatacaaatccttttacggataagatacaggagcttacaaccgagttggaaggatatctgaagaaataacatacatattgtaagaagagagtttccgcactgctttgcacggtgagaccgtgtgatggtagtgctttttttgtatataaataaatgaatcttaaattattagttaaatggttggaatgtatataatcataccgatagtaaccttcatcattggtgggttgcttgcgtggctgggcatgcgtttccttctgaagtcgaagtacgactccgtgcttcaagaggcggagaaggaggccgaggtgataaagaagaacaagatgctggaagtaaaggagaagtttcttcatttgaaagcggacttggaaaaacaggtatcacagcgtaacgctaagatccagtctgtcgagactaaattgaaacaaagagaactgacgatgaatcaacgtcaggaagagttacagcgtaggaataacgaggtagaggctgtaaaggagaatttatcttctcagttggagttggtggagaagaagaagcaagatttggataaacttcatcagaaggaagtggagcatttggaggctatctccgggttgtccgccgaggaagccaaagagcgtttgatcgagtccttaaaggatgaggcaaagacgcaagccgcttcttacatcaacgagatcgtcgaggaggcgaagatgaccgctaataaggaggcgaagaagatcgtgatccagtctatccaacgggtagcgacggagacggctatcgagaactctattaccgtgttccatattgaatcggacgagatcaaaggacgtatcattggccgtgagggacgtaatatccgtgctttggaggccgctaccggtattgagatcgtggtggatgatacgcctgaggctatcgttctttccggattcgatccggttcgccgtgagatcgctcgtttggccttgcatcaattggtacaggacggacgtatccatccggctcgtatcgaggaggtggtaacgaaggtgaagaagcaagtggaagacgaggtcgtagagactggtaagcgtaccgtgatcgatttgggtgtgcacggtttgcatccggaattgatccgtatgatcggtaagatgaagtatcgttcttcttatggacaaaacttgttgcaacatgctcgtgagacggccaacctttgtgccgtgatggcttctgaattgggcttgaacccgaagaaagcgaaacgtgccggattgttacatgatattggtaaagtgcccgatgatgagccggaattgccgcacgctatcttgggtatgaagctttgcgagaaatataaggagaaatcggatatttgcaacgccgtaggcgctcaccacgatgaggtggagatgcagacgctgttggctccgatcgtacaggtttgcgacgctatttcaggtgctcgtccgggcgcacgtcgtgagatcgtagaggcttatatcaagcgtttgaatgatttggaacaattggctttatcgtatccgggtgttgtcaagacttacgctatccaagcgggtagagagttgcgcgtaatcgttggcgctgataagattgacgataaggacaccgagaacttgtccgctgagatcgctaagaagattcaggatgagatgacttatccgggacaggttaagatcacggtgatccgtgagactcgtgcggtaagctacgctaagtaagaagctttttatttggcatatgaatgagagaggccggcttgtgtaagtcggcctctcttgtgaacaaaacataaaatataattttttttattccctaaatcgctcattcttaacaatggttacttgtgtgtaactaagtgattattaagcgcctacttgtgagatataatgagatggaatatctttgcccctataaaaggaacaaagttacttatcggtactaatacttaatattaaatgcttatgattatgaagagtgttgcattgatcgcaatgagccttgggattttcggtgcttcggcacaagacaaaggacgttttgaagtatatgacttcgataacttcaaactgcatgtttattacaccaatgatgtgatgggcgatgccagctatatcgtggaaggcgatcgttcgttagtggcgatggaatatccacttttcaaggaaaacgtagcagagtttgacgcttatctctctcgtatggataagcctgttgaacaaattattacagactaccacgtaggagggagtggtgattatccacaagccatggctaagggaatgcctgcctttgtaaaaggtcctatttatggtggtatgatggaaaatttcaagcggaattttggtaaagcgatggccgagcttcccacgggcgaaagtgaggaaatttcgtttggctctacacgaacatgggctggtgtgacttttaagtttagcgagggggcttcttccgacttcccggcggcaagcattctcattggtggtaaggcttattatacgcattgggctccggcaaaggcgcatgctaaccgtttgcaggtttcttctccggaagctattgatgcggagttggctgaggcagagagggctcttgcgtctggtgcggaactgtttattggtggtcatggtggtgcgacgaatgtggatgacttgaaattcaagattgactatttaaaacgtatgaaacaatcgctgaaagagaatacgactgtcgatacttttgtcaatgcgatgaaaaaggcgtatcccggtctttccggcgaagagggattgggcacgttggctgaagcattatacaaacagaaataaatgctatgaaggtctattgttacatctgcctaatggctgtcgcctcattgctttttgtaggttgttcgggtaaaggctccgtttctcaagaggcggaacaggagaaacttacctatttgatcgataggtatatagaatccattaaccggtgcgacacggcgcttgtcaatcgtatttggtcacatgaggattacgtttcattcattggaccgtcggggtattattctacccattcggaaattcgagacagtttggttctgggtctttttgggacagcgttctcgaaacgcaatttacgtaaagataatttgaaactatccatagacggaaatatagcatggtcagagtttacgtgggtgtttgatgccgtgagaatggatggcactcctcatcatacgaaaggacgagagacgcaaatcttccaaaaaggggagaatggtgaatgggtgctgatacatatccattactcggcactgaaataagagagattaaataaactggagacaatataggatgttaagataaagctgagtgctcagaaaagttgtagattgtaaaatctaaacataaaagagagccttatcattaccccgaaatggagtttgataaggctctttctattgtagatgaaggttgtctagtttcagatataaattcatctatcttttgcccagatcgtcgtataaagtttgtaataggacttttcctttctccaagcgggtctcgtttccgctttcaggttcttctactaaaatcttgttcccttcattgtcgtatacggaaacaccggattcgtctataaagccaaatccattattgaatgtataaaaggcgtaatgcgggacgcaaggattcaatatatctttgctgaatgagaactcatccgtggggagacccatctgatttaataaggtggctgccaaatcggtctggttcgcgtacgtatcgatcactttaggttcagcgatcgctccgcctagccatagcataggtatgtggaaacgcaaaggtccgtactcctgcatgttttcagggtaacggtatccgtggtcggagacaaagatgactaccgtatttttccatgccggcagttccttgaacgtatcaatgaaattgccgatacagctgtccgtaaacgcgacggagtttagataaggatgctccaaatggtgaaacgggacctcgaatggctcatggctacttaatgtcaggaatgtacttaaccaaggtttgccgtcgactggtctttgcttgatatcctcgtaaagatgcgagaacgtgatatcgtcgtttgctccccatttactcagacggctgctcaagggaaaatcacggtctgccgttatcttgctgtagccggaactatagaaataactttgcatattcgtgaaattgatatcacctccatagagcatatccgccgtatatccttctttgttaagactctttgcgatagatggaagggtctggcttttcaccggatacttcatgatggaggtggtgggttgggctaaatagccgttcaatacggagactaagcctcggtcggtacggaacgagttggcatataggttcgtgaataatacaccttctttgctcagccgattcaagttcggcgtaattcccggctcaccaccaacagcctcgatagcatttgccgtgaaactctccatgatgataatgagaatattgggacgagtcgttgtcaatagcttgacaggctctgtaggtatggaatctcccgggcataaggagtcttgggcttgaatgagcgtatcgaataaggctttccgcttttcctccgggtagaaatcgaattgcgaggcaaaatcctgttgcttactcaatgaggctatcagactgaaacacgggttgatcgccgaatgattcaagaactggttctggctgaaataaaccatgccgacatttgccgtagacgtagttacgcctccccggattggaataaacaatattccccctgctaagaggatggcgaaagtacttcccaattgttccaatcccgtaggtggaaagctaggctttactggcgcgaaccggaggatgaaggtgaaccaagcatagatacctagcgcatatgccacgaataccaataattggataaagaacattcccaacggaacactcgccatcgcatcggcgggcgattggaggtagaagaataaagtagcgtccaacctgaatccccaaaagctgtataaagccacatctacggagaagattgccgataccagaattcccatgatcaagaagtaccctttcaataccttcttcaaccaagcgtccggaagccaaactgatactagagtcaataggagagggatggcggtaaggtatcccgctatcgtgcaatccagcttcagcccatgaagcataacctgtaggaagtccgtgaaggtacaagtctcggacaacgcatgctgataaaacataaataccggtttttgaataacaaaaaccggtagccatgcgataaaaacgattagtatgaataataatctttttttcatttcgaatataacttttcccgtaactccgcgatagccggatctgtgatgtaatcatcgtaatccatcatcttatcgatgataccgttaggagtcagctcgatgatacggttcgccacggtctgtatgaactcgtggtcatgactggagaacaggatatttcccttgaatgtcttcaacgtattattgaaggcttggatggattccaagtccaagtggttggtcggagtatccaagatcaagcagttggcgtcggtgagcatcatacgtgagatcatacaacgcatcttctcacctccggaaagtacgcttacctttttcatgagctcctcgcccgagaacaacatacgtccgaggaagcctttcaagaatacctcgttagtatccggcgagaactggcataaccaatcgagcaggttgatatctgtattgaaatatttggagttatcgagaggaagataagaggtcgtgatcgtctgtccccactgatacgtaccggcatccgctttctcctcaccgttgatgatctggaacaaggcggtcatggcacgagggtcgtgactgataaatacgatcttgtcatccttctccacgaagaagttcaagtccttgaacaatacctgtccgtcgatactcttcgacaatcctttcacctctaggatctggttgcccggttcgcggttaggcgtgaacaagattcccggatagcggcgtgaggacggtttgatctcctcgatattcagcttctccaacatcttcttgcgactggtggtctgcttggacttcgctacgttggcgctgaaacggcggataaattcttccaactctttcttcttctcctcggctttcttattctggttctgctgttgacgaagggctaactggctagactcgtaccagaagctatagtttccggcgaataattgtaatttaccaaagtcgatatccacggtatgcgtacaaacggagtcgaggaagtgacggtcgtggctaacaaccaatacggtatgctcgaaattagagagataattctccaaccaagaaaccgtctcaaggtccaagtcgttcgtcggctcatccaataataggttatcgggctgtccgaacaaggcacgggccaataagacacgtactttctgcttaccgctcaagtccttcatatacatataatgcaaatcctccttgatgcctagtccgctcaataggttggcggcgtcgctctctgcgttccagccttccatctcggcgaatttctcttccagttccgatacgcggataccgtcggcgtcgctgaaatcaggtttctcgtaaagggcgtttttctcgctcatcacctcccataaggtcgtgtgccccatcaatacggtatccattaccgtatattcatcgaacgcgaagtgatcttggctcaatacggaaaggcgttcgcccggtcctaggttaacgctacctctggtagggtccaattgcttgctgattacacggagaaacgtagattttccggccccgttagcaccgataataccgtagcaattgcccggtgtaaacttcatgttcacatcctgaaaaaggatgcgttttccaaactgtacgtccagattgttaactgttatcatatttcgtatacctattaaattgcgattgaggatgcaaaggtacgaaaaatattgtttatcttatcattggatgtcatacatcccgctcgttctctcccttttttaggctaattatcttttgggcgttgagcggtgagataacgcttttcccggttttggcttccagtcctcttttcttccattcgtctgttagatctttccgtatctcgatggatttcaatcgttggttgatccaattatccgaatagcccaatcgtttataatcggccatggcttgctcgatagacaattccgggtcttgcatttgatccaaacgttccttcgctacttgggcgatccataacttaaaaggttctgcttttggagatggtactgattggataaggcggaagagttgctcggtattggctacgtcggttaaatatttcttgccatcagcggcctgcattttcagttgactacaatttgtagtcaactcgctaccttctcttttcaatctggtttttaatacactccagtattttcgagggttggggctatctgttaaaatagatataacatcaacgatcgagaaataccattcctcttgttcgtcatcccatatggcgcgaacttttctttcttcgaataagcggatagattctttttgtgtcatttgtagttgctttgagtagttatagacaaaggtaaatgagaatttagtatatccatagtttaatagtttgattaaaagtttatttatcgcaaagtaagtatattaatctcatttaagcaaacgatacgcggtttaaatgagaaggtacgaaaaatattgcttatctttgcattatacattaatatccaattgtgtaatgaataaacaatctgtcatatctcttcttcggaaagcaaagcagcctttgtcgcagagttgcggtgtaaagcagttggggctttttggctctactgttcgtgagagcaatacggaaagtagtgatgtggatatattgatcgactttgaggatgataaagagacttattccaatttccttttggcttgtgagatattagagaagctttttgacagattgaaagtggacatagtcacccttaaagggttaagcccttttattggccagcagatattaaaggaggtagaatatgtgtaagacccctatcgcttatttgctgcatatattggaggaatgtaactacatcctttctgtagttacggatgatctgcctatgtatcaatttctttcggatgaaacgttaaagagggcggtttgccgtagtttggagattgtcggtgaagtgactaagaaaattcccgcagatgttaaatatcaatggagtgacattcaatggaaacatatggctggaatgagagatcggttgattcatgactatatgggtgttaattatctgattgtttgggatgtggcaaagaatattattccaaaattgcaacctcaaatagaagcggtgatagagaaagaacagagtcgttgagagagttgttgtgttagatatgtttagaaaccctgctatttcgtaggtgcttatctagcatggaacagttttatgtcgtatatttgcggcgaatataaaaacgaaataataagaaacagagagtaaacgatagagatataagagattgacatattagtatttgctatttatttcttaatgtagtaaaacgaccaaataataaagctcaagaagaaataagttcgttagcgagtacacccaaacggggtgtgttcctagtgcttatttggtttgggcttgggtgcttggtcgtaccttctacgttctgaataagtagggttcacaccttttttgtgtccttatgcctcttatttattaaccccataatagtatagcctatgatttaaacccattctttccttatttccttaatttatgcttcgccgcatttctccggaagaaaaacgaccaattttattcttaaagcccagagaaaggtaaaggtggatgcgcccccgttttattttgtttcgaaatgggtgcgacacgcttttgcattcttttccctgttggatggagatgcagagcgtggcgcacttttagtttcaaacaatttaaaaacgaatctttttacgatgacaaatgatgagttgcaatcgaagacgattgcctttttgcgctttcccttgatcgtgggggtggtattgatacattgctattataaagaattgccgataggtggtgttaaggttcccgtaatggatgaatatcccatttataaattaatagcggacctgttttctcaagtgctggcacgtactgccgtacccctttttttcttgatatccggttatctgttcttttataagagttcctttagttggcctatgtatggctctaaattgcgaaagcgggcacaaaccttgctgttgccttatctattttggaatggagcattggtgggtttgcacctcttgatagaacttttgtttccatctgtgctttccggtgaggttaaacctgtgctggattacggatggtgtgattggtgggatatcttttgggcgagagaacctagtgagccgggaggaatgccgatgccgatcaactatccgttgtggtttatccgtgatttgatggtattggtggtattctcgccattggtgtacttgtgggctgtgtctttgcgatctctctttctgcgtatggattggaaaaagctcttgggcggactaactccttcttggagggggctagtttctttgtctttgcgtcccatgtaatcgtgcagatctttatatatcgattgatattatggttcttccggtcttctacggaatgggcgattattgggatttacttcggggttgctttgggagctattttgatctgcttggctttctatgccatgcttcggcgcttcctacctaggcttctctctccaatcacgggaggccgatagctttccgtggagcgatgacttgtcagtgggaggcgctttgttatgactatttggtcaggattggcgttttacgctgacaatgcctttttataggcagggtgaactggagggaaaggagagcgaaaaaggtcggtttttaccggttttcgggtctgcggataggcattgtaaggttgttacgatccagttgtagggtgtttacggcggcgttgttagttgctttcgactgcgaatgctattgttttcggagcgaaacactattgttttcgagtgaaaagtctattgttttcgaataagaagtctattgtttgtatgtttgagggtgataagagacgggaatcctcgctagaataaaagccccaaaaacgatatatcattgaaagataactaattgcggatttttattctcaaatttggaagccgactgtactctggggcgaaatattcgattctctggagctttagaatacaaaatgtcagaatgtcaaattgggcgatcttctattattaacaaaggaaatctcattatcttagggcaatgtcataggttgtagagacggggcgtgccccgtctcccgtatcatgtgcgatggattcatgtttctttggctatggatgaaatttggtatggttgccttgtttttatctgaataataaggctggattggaaataaatatctacttttgtgctctaaaacattaaagtaaacgaaaatagaaagatggctgcaacgaaacgaatgaaacgtgccttggtctctgtgtttcacaaagacgggctggacgaaatcctaaagaaattgcatagcgagggtgtgagctttgtatcaacaggtggtactcaatcatttatcgagtcattgggtttgccttgtgatgcggtagaggacttgacttcttatccgtctattttgggcggtcgtgtgaagacgcttcatccgaaggtattcggtggtatcttggctcgccgtgagaacgagaatgaccagaaacaattagctgaatatgagatcccggagattgacttggttatcgttgacctatatcctttcgaggagactgtcgcttccggcgctgaggaacaagcaattattgagaaaatagatataggcggtatctctttgatacgtgccgccgcgaagaacttcaaggatgtggtaatcgtagcttccaaggctcaataccagccgttgatggatcttttgaacgagaagggcgctgagacaagcatcgaggatcgtagatggttcgccaaagaggcattcgccgtttcctcgggttacgactccgctatcttcaattattttgatggccgcgaaggttcccatttccgtgcaacggtagatagcccgatgcatttgcgttatggcgagaatcctcatcaagccgctaagttctatggtaagtttaacgatatgttcgatcaaatccatggaaaagagatttcttacaacaacttattggatatcgacgctgccgtgaacttgatcgatgagttcgacgagctgacgttcgctatcttaaaacataataatgcttgcggtatcgcttcccgcggtaatgtggttgaggcttggaaagaggctttggccggtgacccggtttccgctttcggtggcatcttgatcacgaatactacgattaacaaggaagtggccgaggaaatcaacaagattttcttcgaggtgattatcgctccggcttacgacgctgacgcgctggaggtacttcaacagaagaagaaccgtatcatcttgatccgtaaggattgcaagacttgcccgatgcagttccgttctttattgaatggtgtcttgatgcaggagaaggacttgagtatccaaggtaaggctgatttggagcctatgacggataagcagccgacagcctcggaggttgaggacctgttgttcgccaacaaaatcgtgaagaacagcaagtccaacgcgatcaccttggtgaagaacaagcagctttgcgccagcggtatcgggcagacctctcgtgtggactctttgagacaagccatagagaaggctaaatcattcggcttcgacttgaatggcgccgtgatggcttccgacgctttcttcccgttccccgattgcgttgagatcgcagaccaagcaggtatcacggccgtaatccagccgggaggctctatcaatgataagttgtctgtcgagtactgtaaccaacatggtttggctatggtgaagacaggtgttcgtcattttaaacattaataataagactaatgggattgttttctttcacacaagaagttgccatagatttgggtaccgctaataccattatcacgtgtaatgataagatggtggtagacgaaccttcggtgattgctttggatgctcgctcggacaaggtgctggctgtcggtaaggtggcccgtgagatgtacgagaagacgcacccgaatattcgtaccgtacgaccgcttcgtgagggagttatcgcggatttctatgctgccgagcaaatgattcgcggctttatcaagatggcgagcggaaggaagcgctggttcgctccgtccttacgtatggtgatcggtatcccttcaggtagtacggaggtagagatacgtgccgtgcgagactctgccgagcatgccggtggacgtgatgtgtacatggtttttgagccgatggctgccgctatcggtgtcggtatagatgtcttggcccccgagggtaatatgatcgtggatataggaggtggtactaccgagatcgctgtcatatccttgggtggtatcgtgtcgaataaatcaatccgtatggcgggtgacgatttaacggctgatatcgtggagtatatgcgtcgccaacacaacgtgaaggtgagtgagcgtatggccgagcgtatcaagatcaacgtgggttccgcgcttacggtattggaagacgctccggaggattacgtggttcacggcccgaatcagatgactgccttaccgatggaggtacccgtctcttatcaggagatcgcccactgtttggataagtctatctcgaagatcgaggcggctatcttgagtgccttggagcaaacccctcccgagttatatgccgatatcgtgaaaaacggtatctatttggctggcggtggcgctatgcttcgcggtttggataagcgcttgcgggataagatgaatatccagttccatatcgccgaggatccgttgcatgccgtggcgaaaggtacgggagtcgctttgaagaatattgagaagtttaatttcttaatccgataagagtaaataattgggaattgagaattgaaagttgaaaattagcgagccgataggtctagttcttttcaattttcaattctcaactttcagttttcaattcctatgcgtaagttactagagttcctgatcgggaagaggcattggtttttgttcattctgcttgaggctgtttcgttgatgttggtctatcgtaataatgcgtaccaacggaatattatattcagctcagcgaatgtcgtgacaggatatatcgcctcgatatccggatctgttacttcttatttgaatcttcgggatatcaataaggagttattggagcgtaacggacagttggaattgcaaatgctggatctgcaagatcagttagatgcgctgattgcggatacggttagttttaagggatttgcgccggattcgacggagcaatttccttattcgtttgtcgtggcggatgtagtgaacaacagtgtcacgcatttgtctaattatattaccgtggataaagggaagctggacgggatcatgcccgatatgggagttgtctcggaacgaggtgtggtgggtatcgtatcgacggtttccgatcatttctccgtgatcattccgttgctgaatcctaagttccggttgagttgtaaggtattaggtagtagttatttcgggtcattaagctggaatggacgcaatacgctgtacgccaacctcgatgagttgccgcgccatgtggagttccagaaaggcgatacgatcgtgacgagcggttactcagccgtattcccctcgggtattatcgtaggtacggtcgctgatttcgagaaacaacacgatgataatttctattcattacaggtagagttggctacggatttccaagcgttgaacaacgtgcgtattatcaagaatttccgtcagacggagcaaattggtgtagaacaagaggcgaaaagaaatgattaataatttactgcgtggtttcatatatttcgtggtgtttgtgttgattcaggtcttggtcttgaacaacattcatttcttgcggatcgctaccccgtttctgtatctctatttcattattaagatgccggtcggtagctcacggacgcaagtcgttttcttctctttcatagccggggtggttatcgatacattcagcaacacaccgggtatgcatgcggccgcctgtacattggcgggattttgcagggagccgttaatccgtgtattcatggggaaagatttgccggaaggtatttacccgtcttataagacctttggtttcggaggctttttccgatatgtgttatcgtttgtgttgatacaacatacgactctttttgtgattgagtcgttgactttatttgacccgttgtttctggttgtccgtatcctctcgagcgtggtgatgacaaccttattgatttgtacggtagaagcattcaatatagagtctcagaaaagtggagaataataccaagtatgagtttgagaacaggcgctatgtcttaggtggggcggtgatcctgttggttatcatctttattatccgtttgttcatccttcaggtggtcgacaacgattataaagcttgggcggatagtaacgctttcttgaaaaaaaccttatatccttcccggggtatgatgtacgatcgtaatggtaaattattggtctataaccagcccgcttacgacgtgatgcttatcatgcgtgagatacagcctttcgataccctcgatttctgtgatgtgctgggcatcacgaaagagcaattcctcaaacgtatagcggatattaagaaccggcggttaaatcccggttattcttcctatgtccctcaagtatttatgaaccagctttctgcgcaggaatatggcgtgttgcaggagaagttatacaaatttcccggtttctatatccagaatcgcacgatccgccaatacgagtatcccaatgccgctcttgtgctgggaaatatcggcgaggtaaaccggaaagatatagagaatgacgcttattatacacaaggcgattactccggcagaaccgggatcgagcaatcgtacgaggaatatttgcggggcgtgaaaggagtcgagatcctgttgcgtgacgctcacggacgtatcaaggggcgatacgaggaaggcaggcacgatatccagccggaatccggcaagaacttgaaattatccttggatatggacttgcaggcttatggggagaagttaatgcagaataaattagggggtatcgtgatgatagagccggagacaggggaggtactttgtatggtttccgctcctacatatgatccgagtatcttgatcgggcgccagcggggaaagaactacgtggctttgcagaaggacccgttgaaacctttattcaaccgcccgctcatggcgcaatatcctcccggatctacatttaaaccgactcaaggtttgatcttcttgcaagaaggggtgattactccggaaactcaatatacctgtgcgcatggatataccttccggggaggtaagccggcttgtcacgggcatccgtctcctctgaatctggtcggggcgttggcgacctcttgtaactcttttttcccttggggactgcatgatatgatcgacagccggaagcgatatccgtcggtacaggaggcttttgaggtttggaagaattatatggtttctatggggtatggctataagctgggaatcgatcttccgggggagaagcgagggttcattccgaatagtaagttctacgataaggtgtaccggggacgttggaattccagtacggttatctcgatcgctatcggtcagggtgagatattggctacgcctttgcaaatctgtaatttggcggctactgtcgctaatcggggatattatattactccgcatgtcgtgaaagagattcaagacaccccgctggatacattatatagtaagaggcattatacatcggtggatacgcattattatagttatattgccgagggtatgcgaggggctgttacgggaaccgcttatggtggaacctgtcgtggggcggctttaccggatatcgaggtttgtggaaagacgggaacgtcggagaacccgcatggtaaggaccattctatttttatgggattcgctccttatcaaaagccgaaggtcgccattgccgtgtttgtggaaaacgccggattcggtgctacctatgcggtgcctatcggtaaattgatgttggagaaatatttgaaaggagaaatatccgaggctaacaaggcgacggaggaatatattatgaatgccgtaatactaccgaacaatgcgctataggaaaacggaaatatggaagtcggtagactggattaccattttgttgtatttgattatggtaatcgccggttggtttagtatttgtggggcgagctacgagtttgataacgttggcttgttcgacccgtcgggccgtccggggatgcagatgatttggatcggtacctcactcgcccttattttcgtcatattgatgctggaaagtgacttcttcgatatattcgcctatctgatctatgcgtgcgtgatcgtattgttgatcgccactatatttttagcacctaatatcaagggatcgcattcttggctcgtattgggacctatccgtttgcaaccagcggagttggctaagttcgctaccgctttggccgtggcgaagtttatgaatggctatggctttaagctaacgacggtcaagaatttctcaatcactttgttcttgatcttcttgccgatggtttgtattcttttacagaaagagacggggtcggcattggtttacttggcattcttcctgatgttataccgggaaggaatgactggatatattttgttgataggagtttgtgcggtcgtctttttcgttacgggaatgaaatattcagaggtgatggtgggtattaccccattgggtgaattaatcgtctcttgccttgtcttattaataaccatgggattagttgggagtgtccgtaaggattatataagcgttaagatcatgcttgggggaattgcttcgacattcttgatcgggtatgtcgtttctttgtttgtcccggtaaacttcgcttggatatcgataggcttggtaggagccgcgtcaatctatttattctatttatccattcgaaactgggtatggcattatgcgttaatcgctctgttcgctttaggttctatctgtttcctattttctgtggattatgtgtttaatgacatattggaacctcaccaacaaattcgtattaaagtctctttaggcttggaggatgatcctagcggggcggggtataatgtgaatcaatccaagatcgctatcggttccggaggattatccggaaaaggattcttgaatgggacgcagaccaaattgaagtatgtgccggaacaggatacggattttatcttttgtacggtaggcgaggagcaaggctttttgggagcctctgccgtattgatcgtattcggactttttattcttcgtctgattgtattggcggagcggcaagataatgctttcgggcgagtctatggctatagcgtagcctccatattctttttccatctggcgattaatgtcggcatggtgacgggattgactccggttatcggcattcccttgcctttctttagctatggaggttcctcgctctggggatttacgatcttattgtttatttttcttcgtttggacgcttcccggaaggagcgttagtggaagaaggtaagacccgtaagccgatttcctgaatgcccggaagttggtcgttacgcatcccctgccggaagctaaaggtatattgccctttaacggggaaatagtaagcagatcgtatcgggaaactggattgaaacagggagatcccgtgcccataccatttcccaaactcatcagctaacatacattcgatcgtatccctttttaaaggacctatcggaagttcctcgctgcaaaatacccataggttctgatacggatacatattattgttccgtacttccaaggttaggtcgtacggaaccgatatatcctcaatcaagaaagtgaaatagtactccttattcttctcccacgaggtgttttggatagcttgatactgatcgtatacagcttcattctcgcaagagaagcataagaagcatgttacacaggcggcaatgaactttttaagcctcaggctttgtctctggcctattctccgttttatcaggtctggcctgtttgatcggttgctgaggtttgtcattattcgcaggcttgtcattgttggattgcttatcgttattagctctcggcctttgtttcgggcgattgtttcggttgttctccctgttattatcacggttgttctcccgattctcccgactgttttcccggctattatctttgttattctcccggttattctctctgtcccggttattctcacgattgctattcctattatttcctccgttgcggcgattattgccaccggctccgtttcctccgttgttcttattctcagaaacaggtgcgtcggtgttggtaactgccgtcgcggtggtgttagctccgttcccgtttccattgttgtcgccattattcttgttggcaggacgttttttctttttctttttaacagagtcgaaacgtgtgacgctttcttgcccaagaatatcttgagcgtctcgtttcggtggttgtggcttcgtatccgcctctagagatatcggcttcatgcctttcttattcatgttaatgacatcgaaagcacggcttgccggaatcgtgataagattagccgcaaatgatttatccgtagaataggtaatttcccgtttgaaaatatccgtcttgaaatgatagtaattattatctttggtctccaagacaatctcccgggaaggaaggcgtttctgggcttccacatatgtatctacctcataattgatacaacatttcaatttagcgcattgtccggccaatttctggggattcatggaaatatcttgataacgggcagctccggtagcgaccgatacaaaacttgtcatccaactggaacagcaaagttctctaccgcaagggccgataccaccgatacgtccggcttcttgacgagcaccgatctgcttcatctcgatacgaacacgaaaagcctccgctagcactttaattagttgacggaaatctacacgttcatccgctatataataaaagatcgccttattaccgtcaccttgatactctacatcaccgattttcatattcaatcctaaatcggctgcgatttgccgcgagcgaatcatagtggcatgttcctttgctttcgcttcctcatatttctcgatatcggtcggttttgcctttcggtaaatccgttttggctcagcttccgtgcgcacgttgttcttcttcatttgcagcagaaccaattttcccgttaaagaaaccgtaccgatatcatgaccgggacttgcctctacggctactatatcacctttttccaaaggtattttagcactattcaagtaataccctttgcgggtatttttaaattgaacctctacgaagtcagtcgagccttccgcgtcgggtacatcgcacaaccaatcataggtattcagtttattgttttgccttttgctgcaacctttgcagcccatatggctacttcctttatctaatatgaaatccatttatttttaatttgtaagagggccatcgacataaccgcccaatttatctaaatatgcaaaaatagtgatttattcccattcaaaatcatagttatgattttttcagttataaaaaaagacccgaagataggtgttatacctaaccttcgggccttttcttatatatttacacgattagtctaccaacccatggctcttgaataccttgtggattgtctccaaagcgtaatctagttgctctttcgtgtgggtagccataagggagaagcggatcagtgtatcctcggaagcaactgcgggagctactaccgggtttacgaagattccggcctcaaataattcttttacgataaggaatgtcaagtcgttgtcacggataaacaacgggatgatcggggtagaagtatgtccgatctcacaacccatgttacggaaaccatccaatgcgtaatgagtcaaatcccataaatgttggatacgttccggttcgcttaacatgatatctaatgccgcgttcgctgcggcagtagcggcaggcgtattgcttgcgctaaagatataggaacgggagtggtgacgtaagtaattgataaccggttcgtccgatgcgataaaaccaccgatagaagcgaaagacttactgaaagttcccatgatcaaatcaacatcgttcgtaacgccgaagtgattacaagtaccgcggccatgatcaccgaatacaccgataccatgagcctcgtcaaccattacacttgcgttatatttctttgcgagagctacgatttccggtaatttagcgacatcaccttccatgctgaagacaccgtcgataacgataagtttcaccttgtctggctcgcatttctggagttgtttctccaaggagtccatatcgttatgcttgaatttcaatttcgtggagaaagaaagacgatgtccttcgataatggatgcatgatccaactcatcccaaaggatatagtcctcacgtccggtgatacaggatacaacacctagattaacttggaaacctgtagagtatacgatggcgtcttctttaccaacaaattctgctaaacgtttttccaactggaggtgtaagtccaacgttccgtttaagaaacgtgagccggcacaacctgtaccatactttttaatggcctcgatcgctgcttcttttactttaggatgattggttaatcctaagtacgcattagaaccaaacatcaagactttcttcccgctgattagaacttccgtgtcctgatcgctctggatttccctgaagtaaggatagattcccattgccatggctctttgaggagcgtcgtactttgctagtttctcttgtaaaagtttcatattattataaaagagaatgatttatctcgctatttatttattctaataaagaacacaggttcgccgcgtacataatcccatgtttcggcaaatccagccgcaaaagtagtaaaaaaataacttatagtagtcgaaatgctttaaaagttttataaaagcattatttttgtcctctcaaataaaaaagaagaagtgaggatgagcgaacgggatataaaagtacaagctatcataaaccctatatcaggtgtagggtcgaagcgcaagatacctaagatgatcgaagggatctgctcgaaaaagaactgttcgttaaacatttcttttacagagtatgcaggccatgccagcgagttgactcggcaagccatagaggaaggagctgaatatattttggcggtaggcggtgacgggacggtgaatgagatagcgagagctatgatccattcgaacgcgatcttaggtatcatcccgaaaggttcgggcaatggcttagctagagaattgcacataccgatggacgtgaaaagggctatcgatctgatcgcgaaagggcatgttacgacgatagattgctgccgggcgaacggacaggtctttttctgtacctgtggagtcggttttgatgccgccgtcagccagaaattcgcaaatgagaaacggcgcgggtctcttacttatataaagaatacgatagaggagtatctgagctataagcctgagccttatgaattggtggtagataatcagacgatcaaggagaaggcgtttctagtcgcttgcgcgaatgcttcgcaatatggtaataacgcgtttatcgctccgcacgcgaatatacaggacggacggatggacgttacgatcttatccccttttatgccattggatatcgctcctttggccatccaattgtttaccaaacagattgatcggaatagtaagattaagacgatgaaagcccagcaagtcacgattattcgccaacatccgggcgtgatgcacttggatggagaaccgatcatggcagatcgccgtatcgatattacggtggaaccaaaggccttacatgtgctgactccggaggttgtgtctttcaccaaggaggtacataatttatttgacgaggtaactcgcttcttcgataaaaaacttccttacattttcaagtaaaagtctttagctatagcggtgaattcatcgctatatcgatgccgctcgatttctagggtcagatgagacgacttgggttttgctaccggcgtcgctgagagttctattaataagcgcttaggaggggcgtccggtatgggggaaacgtgggcttctctcgatggcgataaagactcttctcgagcgaggtctattaaagactcccgttgatcaaagggaagcaccaaggcgatatttccttcgggtgccaacagtttgcggctatcacgcaataaatccgggagagatagagtatccgtatgccgggctagattacgtttagtatccgggcatttcaatgaatcaataaaatagggtgggttggatacgatcaagtcatatttgatattctcatccggcatatattcggagagcgaggtttgatagacttgtatccggttggcgaaaggcgatttcgcgatgttttcctgagcttgtaaacatgcgtctgaatctatatcgatagcgtctaggatcgcggtgctacgctgcgccagcatgagggcgatcaatcccgttccggttcccacatccaaaatcctctgacatctctctatgctagcccacgccccaagcaaaacgccatccgttccgactttcatggcacatttatcgtgccataccgtaaatttcttgaattgaaaataaggatttgccatatctctatcgattgtatgccgcgaaattagtaagaattgaatgaaaagctgtaactttggcacgtttattgtattaacatatacaatgatgaatgtatatatgaaagaaaagacgagagtattttgccagaattcgtttgatgacttggatgacaatattggtatcgtaatgccaattcttacagaatgcgatgtagatgaggatttcacagaaggaatagagaaagttggagacactatacccattcttccgttaaggaatatggtactctttccgggtgttgccttgccggtgattatcgggcgtcctaaatcgatgcgcctgattaaagaggctgtacataaaaagagtttgatcggagttgtttgccagaaagagatgggtacggaagatcctatcttagaggatttatatacaaccggggtaatcgctgacatcgttcgtgtcttagagatgccggacggtagtactactgttattcttcaaggtaagaaacgctttgaattgaatgagttgaccgagacagatccgtatctttccggtaagatcaccgtgttggaggacacgaagccggacaagacagaccgcgagttcgaggctttgatctcaacgatcaaggatttgaccatcaagatgcttggggccgtggctgaacctccccgggatttgatcttctcgatcaagaataataagaatgtcttgtatgtggtcaatttctcttgtagcaatataccgagtggatcggccgagaaacagcaattgttattgatcggggacttaaaagagcgtgcgtatcggttactttttatcttgaaccgcgagtatcagctggtggagttgaaagcttccatccagatgaagacgcatgaggatatcaatcaacaacaaaaagaatatttccttcaacagcagatcaagaccattcaagaggaattgggcgggaatatcaatgagttggagataaaagaattacgggagaaagccagtcgtaagaaatggcctgccgaggtagcgcaggtctttgagaaggaattgcgaaaattggaacgattgcatccgcaatctccggattattccgtacagacgcaatatgtccagaatatcgttaacttgccgtggaacgagtatagtaaggacaatttcaacttgtctcatgcccagaaggtcttagatcgtgatcattatggtttggagaaggtgaaagagcgtattatcgagcatctggccgtattgaagctgaaaggggatatgaaatctccgattatctgtttgtacggtcctccgggagtcggcaagacttcattggggcgttccatcgcagaggctttgcgccgcaaatatgtacgtgtttctttaggtggattgcacgatgaggccgagatccgcggacatcgtcgtacctatattggtgctatgtgcggacgtatcatccagaatatacagaaggcgggaacatcgaaccctgtctttatcttagatgagatcgataagatcacgaatgatttcaagggggatccagcatccgctttattggaggtcttggacccggagcagaataatgcgtttcacgataattatctggatatcgattacgatttaagcaaggtaatgtttatcgctaccgctaacaatttgaatacgatttcccagccgttgctggatcgtatggaactgatcgaggtgagcggttatatcatggaggagaaggtagagatcgcagcgaagcatctcgtgcctaagcagatggatgtacacggcttgaagaaaggttccgtgaaattccccaagaaaaccttacaagtgatcgttgaagcctatacacgcgagagcggtgtccgggaattggataagaaaatcgccaaaatcatgcgtaagctagcccgtaaggtcgctagcgacgagcctatcccgacgagcattaagccggaggatttgtatgaatatctaggggcggtcgaatattcccgcgataaatatcaagggaatgactatgccggcgtggttacgggattagcttggacagctgttggtggtgagattcttttcgtggagtcgagcttaagtaaaggtaagggatcaaagcttactttgaccgggaatctgggagatgtgatgaaagagtctgccatgttggcacttgagtatatccatgcgcatgcggctcagtttaatatcaacgaggagttgttcgagaactggaatgtgcatgtccacgtaccggagggggcgatcccgaaagacggaccgagtgccggaataacgatggtgacttctcttgtctccgcctttactcagcgtaaggtgaaaaagaacttggctatgaccggcgagatcacgttgcgtggcaaagtgcttcctgtaggtggtatcaaggagaagatcttggcggctaaacgtgccgggatcaaggagttgattctttgcaaggagaatgagaaggatatcaatgagattaaaccggagtatttgaaaggcttggtgttccattatgtgagtgacattcaacaggtggtggatctggcgttgctgagagaaaaggtggataatccattgttttaataacgactttttatgcatatattggtgtgggcttatacgtatatacgtgtaggcccatattaatatcggcgtaagcctatacgtatatacgtgtgggcctatgccgatataggtgtttttaaaggaagagtatgcctttatttagagcatttctgtaggaattccaagctgttgcgtatctcttggatatcggatttgaaatcatcgtactcaatggagataagcccgttgaaatgctgacgcttcagctcgttgacgaacgcttttaccggtaagatcccggttccccatgtagcgtcttccatcttgtcggtgaggtctttcaaatgtgccaccttgatgcgtccggataacttctggagatttttgagcggatcttcacccacccgtttccaatggccgatatcggcgcatactcccatcaaggaagaacggcctttcagcgctttctctaccacctcggcacttgcgtaaatgcatggactcggatggttatggatcgctacctccatatcgtacttcttggcgagggattcgatgtagtccaactggtttaactccggttcgacagtcacgatatgtgcgcctattttatgagcgaacgcgaagaacttatcccattcctcgttagtcccataagaggctacaccaaaggcgatcggtttgatcccccttttcttgaactcatggcgtaataaagcgcagtcatcatcgctcaagtcgtaatttaaatacgtctcttttgggaacggagcgcccaattcttggaaaaagaaagcctccgcataccccatgcccagttgctgggtcttatccaaggtctccatcaacgtaagattgtggaaagtccaagtctgtatacccaccttccagtccgctttttgcgccgccagctgtacggcctgcccaaggagcatgaccgtacatagtgctaatataatatatcgtttcatacttataccggcatttccggaaggctccagccttcacgataggtatgtctgatatattcgttggcagcctctagcgcattgaactccgcgtatttcgtatcgaaataggggtgaccgtctatcaccttgaaatcatcgctggttacgatcttcaatacgtcggaagaggatatattggtgaaacgcatgttttgggcgtcccacatcaatttcttgttcaagccttgcagacggatcgctaatacacccaatagcaccatctcgttgaatggtccggaataagcgaagttggaagttccttccacacggttctccggcgattctttacaagcacggatccagtcttgctcatggaaaccgtcaaagtatccggtagcgttcgggatacggcgcaaatagggggttacttgaggtacacggccggataataaccgggagttgaaacctccgcaatcgcagatcaacgtgtctttagtacctacgaagatacatccacccaaaccgtcacgcatcatatctacaccatccggtaataagtccggacgctgaggaagcataccgccatcgtaccaatatactttcacttccggcaaggctacctttggaagattgtcacgagccgggaagcggaattctaccacctccgattgaggagcggattccgtattgatctgggtagaacggccttgtacacgatccggataacctaacttcaaggattggtaaaccggatcgagcacgtggcaagccatatctccgaaagctccggttccgaaatcccaccatccacgccagttccaaggggtgtagatctcatggaacggacgcatggcggccgggccgataaataagtcccaattcatcgtcttcggacaacgttgtttttcggttgggcgctgtaatccttgcggccagatcggacggttggtccatgcgtgtacttcttttacttcaccgatctctccgttccagatccattcgcataattgacggacaccatcgccggagttcccttggttacccatctgggtcgctaccttatatttagcggcgagttttgtcaataaacggctctcgtaaacagagtgggtaagcggcttttggcaatatacgtgtttacccattgtcaaggccgtggccgcgatcgtggcatgagtatggtccggagtagctaccatgacaccgtcgatctggtcgcccaactcatcgaacatcttccgccagtcccaataacgtttagcgtccgggaattcctcgaagcagttcttcgcgtatttccagtcgatatcgcaaagcccgatgatgttctcggttttcatgccgaccaagttcgggtggcctttaccaccgataccgataccgacaatattcattgtatcacttggtgccttatggcctaatccagcgatcgttttagaggggacgattgttagaccagctgccgctacggctgcttttttcagaaaatctcttcttgattccatgttgtataatttgtttttttagtagttactgttagaaattgaaacaggaggttaccattctatgatctgaagggtaaggggagactaccacgtccgaggtggcctcgctttcgcctgtgataaatgagtctgttaccttacatccggaatatagtacgaaatccagacggtctagtatttcttgttcgctaggaacgggagtccatgtatagccgggtgtggagacctcgtccggatggattgtccggtaggagtcgttcatcccgatctcagagaaagccttggttgccggccactccaccttgatcttgtggataccggcatcggcggcccgttgtgtccagtccaagaaagaaggctcattaaaatctcctgttaaaaagacaggataaccttctttcatgacttgctgtatatctttttgataacgagttacttcttcacgtcgggcctcgttggcgaaccggacagcttcctcctcggtatcgataaacggataatcgccataaggaatcccattcaattgataaggctgatacgggatataatatagatggcaattaaacatccagcagaatttgtctttgcctacctgtatcttcaccccgtagcgggaagccgtactgtcaacgaccggataacgagataagatataatgtccctccccttggttgaaaaggtggaaacctagggattccgcgatttccggcacatgatcgtgcttgatgccgtcttcttcatagatatgcccttcttggattcctacgatatccgtctggctagcctcgatcactttcgctgtctggctagggggaagctttcctcctagggtattcaaccaaatattgaaactgctgacttttaccgttgccggcttgtcgctacatgcgctcaatgcacaacaaagtatggctacgcagcataaaatctcacttatcttcctcatgtttctctggtatttacaggaacaaatatattaaatgtcccgttcttttcactactaagacttcttaatttattttaccatcggccaaggaaacttcgatacaagctggatgcgttgacctgtagcttgtgattttcgggcggcctcgataatctctaatacgtgtaacgcatgctcgacatttatacgtggttccgtgtttaatgccatgtgtttgctgatatcggaagcaccttcttgccaaacatagccattggtgtccggaacgaaacgctggggtaccggatgatccatcgtcgataagtccaccccgttcggtgcccagtcgtaacctaccatatgcatattgccgtgggaaccgtataaggagatcgtcgctttctcctgtcctttacctaaatgtccgtatggatcgaaatagttgaaaccacactcgatatgagaaaggactcccttttcgtgttccatgataatcatggcattatcttcttctcgaactttgatcttgcccttatcgtctacggttctctccggggttacgattgtagtcatggcaacaacggatttagccggtcccaataatccggttagggtagcgatgttatagactcctaagtcgggcatactgccacctagcggttcgtagaagaaagcggaccaagaaggaccttcatgtccgtaatgtccgtgcgcgcatgccagattacctagggttcctttattgatttgttcggccataaaggcaaattgaggactgtttacaacggcaggcgcaccccagatacgaagccccttgctagtagcgagatcgtataattctttgccttccttataggaattcgccaaaggtttctcgctccagacatttcttcccgccatcaaagccttacggtttaactctccgtgaacctgcatatcggtcaatgtaagcatcaagtcgaacttggaaccactaagcatatcatcgatatgcttgtaccatttaggtatattatattgcttggcagccttttgagcacgatccggtttgatatcgcaacaagccacgatttctacatacgggcatttcgatatatggggaaaatattgggtagatacacttccgcagccgataacggctactttcacctttttaccttccgattcgaatttctccgcataggcggaaaggggtgatagtagtgacgcgagacttgccgcggccgatactttaaagaattcttttctattcatggcattgattttttaatacaattagtctaaatccttaatctttacattcttgaaatatactttacttccatggtcctgaaaacaaagtttaccggtggtagagataccgtaatcggggaaagcttcccatttaccgctataacgacgcatcttccaatcttcggacccttcttggaaagagaatagtttttctccgttcagccagtgctcaacatatccatccttgtaaagtaccatagaggagttccattctcccggagggttcacctgtttggtttccggtacatacatagcgtagttgcaacccgttttctgccagtcttccaatccctcttttccggtctcgctgacccaaggatagttatcgtcatcgatcaactggtattccgggccggtttcaaaaggagctttgtatttaggtccttcttgtacgtgatataagaatcctgagtttccttgcgccccgattttccaatcccatttgatctggaagttatggtaattcttaacggtaacgatatcggtacttaccttgatcgtggtatccgctatcacgtcaccaccgtttccgtagccgacgatcaccccgtcttctacctgccatcccttgacatcacccccgttgaacattttccaaccggtaaaatccttgccattgaataacaaggtatagccttccgctttttcttcctcagtcaatacattatcttttacttccgtggatgaggaacgacttccacatgcaaccatacacatcccgtaaatggttactagaaaaatagatacgatctttttcatctgttagaatatttagtttgattatctccttatgataacgccatttgatatggtttatttgttcattggcaaaaatactgcacataaaggatttggataatagagtatctagctaaaaaaaatggattatctttgcgttattcagtaaccatctaaaagttttggtttatggcgaaaataaagcatggtttttccggtcagcggttgattgtctatcctttctacattatagaacaagcgttgaacaacccgttggtcgcggacttggtcgtacactctatggggtattttccgaaggcggaaaaccattatattgatcgtgcgtccggttgtggagagtatcttttaatttattgcaccaaaggagagggctggtacgtgttggatggaaaacgatatgtcgtacccgagaatcattttttcatcctcccggcagagaagccccatcaatatggttcgagtgagcatgatccttggtatatttattgggcacattttaaagggaaaaaggcgaagtatatcagcgatcaactgcaaggggtgatcccgatcgacatggatgataattcccgtatcggcgatcgtatcgctttttttgatgaactattgaatgtgttggagagtgggacggatgaggctacggttaattatgtcaatttaagtttcaatcatttgatcgcctctttcctctatgtgaagacgtatagggaggctaaattctccaaaagcaaggcggagaatacgttctttattagtttggcgacccacttcatgacggagaatctggaaaataaattgacattaaaggaattggcctctcatttcggctattcggaatcttatatgtacaggcttttcttcaaggaaaccggttatgctccgatgaattatttcttgcatatgaaaatagaccgggcttgccagctattattacatacgaatatgaagatcaatcaagtcgccttgaaactgggctttgacgatccctactatttcagccgtatctttaagaagatagtagggacatcacccaaggattaccggcactcgttaccgaagtgagatatttacgatgaacctaaacgggaatttagggctgccctaaacgagggcttagggataccctaaacgggagcttagggctggcggtatttattccggtcggcttccgttatttcccggattacacggcagggattgccggcagctataacattggccggaatatctttggttacgacactacctccggcgattaccgtgttatcgccaatggtcacccccggaaggatacaggcttgcgcaccgatccatacgttatcgccgatggtcacgggaaaagcgtattccaaaccctcattacgttgctttacgtcaaaagggtggccggcggtatagatgcctacgttcggggcgatgaatgcgttattgccgatacgaactttcgctccatccaagataacgagattcacgttggcgaagaaattatccccaatctcgatattatagccataatcgcattggaaaggggataggataacggtgttcttccctttcttgcctagaaaagaggttagaatccgatctttttcttcctcttggtcggggggcaattggttgtatttgaaaaggacgcatttcgttcttttcatctcatcttgaagctcactatcatgattcgcattgtataatagaccttccgccgctttctctttttctgttttcatatgtctcttactaagatttataaaacgatgatttgcgcgaagatactattttattgggaggagtttatcctccgattcgtatttccaaacccattttttcccccatctccttaaaggggaacagctcttctttggctagcatttgctcgcagggataaggataggtgagacctaattgctcgtatttatcttttcccaatgtatggtagggaagcaggtgtacgcatttgatacgattttctttcgccagcatgaatatttcccgaagcgtattctcattgaaattgaaaccggggattaccggtacacggatcgttactttattagcgctcttactggatatataccgtaaattcgtgaggatcgtatccaagttcgctccagtttctttctgaagtaaatccttgtccgtatgtttgatatcgaacaagaacaaatcgataagcggaagcgcttgctttatcttatcaagattcacttgcccgcaagtctctacggaggtatgcagtttctcgttcttgcattggatcagcaaatccatcaatccctcgaattgcgtgaaagcttcccctcccgaaaacgtaacccctccaccggaattcaggtaataatcccggtcacgtaaaaggatttccataacctcggatgaggtaattgattcaccgacaaacttaatagcgttctgcgggcatatacgctcgcaagccttgcacgccacacaagcctgccgattaaataccggataatgatcttggatagagatatttccccgtgtacaaatcgcctcgcaacgtccgcatccgatacatttattcttgatatggagcagatgcggtttccttttctgggattccggattggagcaccatgaacaatgtaggggacaaccttgaaggaaaacgacggtccggatgcccgggccgtcgtgaacggcgaaccgttcgatctccatgattgataacctattctcgctaaccttatatttattcatcatataataccctgcttaaaagttcctgttgaatattgggagataaatcgacgaataccgcggagaacccgcttacccggacgattaggtccgggtaattttccgggtgctctaccgcgtcttctaaaactcccttatctactacagtcaccatcaaatggcaaccccctttcgcaaaataagtcttgaacaggctcttgatgacagccctgttctcgttgaacatggaaggagaaaacttaatgttttgtaccgagcctccatgatacttggcgtcgaacttcgccaaggaattcagcatggccgtggggccgcttttattcgctcccccttgcggattattggcaggattcatatacatgcacgataatcgtccgtcgggtgaggcggcggtccggtttccccattccgtgtttaattgattattgctgataacgatcaagaagtattgcataccgatggcgataccgcgatcgcgtacacctttcgctacgaactcgtacaaatcgttggccatcgtatcggcagtctcaaggtcgttaccatatttatcacagtttaggcaatcttttcgtaaagcctcatagccgttaaaattagctagcatggcatcatttaattgccgtaacgtgtattttttttgattgaataccagatcccggattacccacagggaatcggaagtgttgatattgccatacgtctcgtttgtcccgcctagataacgtacgcctccgtccaaaagcgcttttccccgtgcgatgcaatcatcggtcaataggctggtaaacaagaaacttacgtgctggttcatcacctcatacgaatggtattgggctttgacagacagatccagataataatcgagtaaagccttgtaaccgtcatagaattcctcgaatgtctgatactcctctaatttctttagaggtaccggcccggatttacgtttaccgtcaatcgggtcgataccatcattcatataaatcgtaagtagttttagtaaattgatgcagatgttgggcgtacccgtactttgtccttgtatcacgaactcggtacacccgaaaggcacgtattgttccgctgctttctcgtctacacgcattccgtacatgacggccgggacgtttacgtcgtcattgtaaagggtcgggtaagtagctcccgcacccaaagcgtccaacgcttcgtcccagatttcctcggaggtatctttatcgaaacgcaaggtgaattgcggctctacatacctgcaatttttcgctactttcatggcgatatgcaggaatacgtcggcctctttcgggtgcttgcgtcctttaccgcctacgatgatacgtccgtttacggttgtacggcgattttcaatcatggtccaaagcgagtggatatatcggtatgcctcttcgtcggtcaatcgcccggacttgagatcggctactaaataagggcctagataatcatccagacgaccgtagtttataacaccggccaacaaagcgaataaccagaataactgcatcgcttcatggaacgtaccgggtttcttctccttgatgttctctagggcttggcagatacgctctaattctttttgccttttcatgttggctgaagccatttgctctctagcgtcttgctggagatgagaagcacaatctacaaaaatatccagacattggatgcctgctttgtaaaagttattatcgggttgctctttgagtttctcctgtaaatcagagcgaaggccaccgatgcccttatccaatagtttcgggtaatccagcatcattccggatagacgtgcggtagcgatcatcgggtattcgcagtcgatgaacatacccaatgtatcctcggtgaggacctccttgttgaattgggtctttaaatcgtgatccaaccaataatcatataacgtatccacccgttttcgttcagtttcatccagttgttgctggaaggcacggagtttcttgaatacgcaataatgcccgacaccccctaatgaggttacgcatccgaacccgatgggtaggaagtccgtacgtccggcgatcaagtcttgatccgtgatcttgcgaaatagcgtggggtataaaactttcaggcattccacttcacgtatctctttgggtagggcggcacaggctttatggactgccgtataccgctccatgatctccagttgtacgatcagaggtttctcgcaaggtattttcttgctgatctctacgttttgcgccccttctacattgaaatttgccatatgactattaatgtttgcttctttcggcttcccgccagttattttggtaaccggttagtaagtccgtaaaacgtttcgtgatcaagtgcggacgggtgatcgcgctacctactactacggagtgagctccgaggaagatacatttcatggcatcttccggcgagtagatatgcccctccataatgacgtaggccttgcccttgaagtcacggcacatacgggcgaactcccgtaaatccggttgctcgatatgtttggtagcttccgtatacccatataaggtagggccaacgatatcggctcccatttctacggcacgtacggcttcctcataattggatacgtcggcgaagatgatcgcttccggaatttccttttttaagatcggtagcagttcgtatgccgggtggccttcatgagtgatttggctcgtacagtccaaggcgataatctcggctccggcttcccataccgctttagcggcctctagggtgggagtgataaatacgtccgtatcatcgtgccagattttccaaagcccgattaccggcaaatccacctcttttttgatcgccttgatctgctccgggtcgttggcacggatgcctacggcacctccccattgggcggcttttgccatttttacgacaaagtctactgaaaaagtcggatcatcgtgttgtacttgacaggatacgatcagtcctcccttgaatgagtctaaaagttctttcttatttgttttcatattttttttcgttacatcgttttctctaaaagtgcggcgccgattattccggcgtcatttcctaattccgcacggataacttgagggatacctatttcctcggcggcgaaggtacaagtatgtagtttctcgtttagaggtttcaacagcaggtcacctgcatgtgcgataccaccccctaagatgattacttgcggacggaagatggttatgaacgtggagattccggcggccagtctactgatatagtcatcgacgatctgtttagcgagggaatccccttgtctagcggcctcgaaaagaatctctccattgactttgttttcgtcttcgccgcaaagtttccatatcaaggtgtccttattcttttgtaaggtctctttcatgatacggattaatgcggtggatgagcaataagcttccaaacagcctttttgcccgcatgtgcagcgttcgccattgtataccaatttggtatgtccgagttcggctcccatattatcggatccggaataaatcttcttacccatgataattccgcctccgactcccgttcctagcgttagcatgatggcgtcggtatattggctggccgatccggccaagacctctccataggtcgcgcaattggcgtcgttggctatataagtaggcaatgagatatgcttctttaaatagtcgtagatggggacattcttccatccgaaacaattggcatgtaccaaaaggttcgtctttggatttacgtaactgggcatgccgatgccccaagaagagatgtcttccatttgcaagcctgctttgagaaccgcttttttgctgacttccgccatgtcggtggtgatctcctcgattgtgcgtccggcttgtgtcggtatactctcctttgcgataatctggtgattctcatctactacgccagcgaccatattggtaccgccaacgtccagaccgagataatacttggtgctttccatctttgctctttattttatgaggtcaatagagtgaattatttgttggcaaagatagaggagttacccgccctagacaatgtgaggtttagcctaaaataatggactatttttgcataagtgctcttgttggttaatgtggcaatataaaaaaaggaccggacgatgggtatcgaacggtcctttctttaatctttatgtcgtatgctgttattcagcttctttttcagcagcttccttttctgccggagcatcttccggggtgaagtcagtgatgcctgcgttgatcaagatgttataccaagagagtagtttcttgatgtcgcttggataaacacgctcacgatcatagttaggcaatacctcggcaaagtacgcacgcaattggtccgtcgtggctttagaaggtactaaagaggcggcttttccctcttctttattctttacgctagtcaatacctcatgcaaaggcacttctgtttcatccgtatagattgcgatatcgcctaatgagattactttatcttttgcgtatgcgggtactctcttgttatcagtcagcgattcaacgatcaacatgttttttccatgggaaaccagtttatacagaccgggttttcccgaaatagacaaaatagtcttcaacataatgttttttattttctattagtgttaaacttcgaggtggcaaaggtaataagaaaaagtggaattcttccgtcatgaggacagttaacttcgttggagaagtatcttaggtgcatcgacaaagtatcttaggttcgttgacgaagtatcttaagttcattggatgatgaaggtaagatactgtaaaagccactcgtcccgctatcggtgattattgggattgaagccaacataacagtttgcctacttgcggtataagggcctgtctgttgtcattatagataacgtaatcggagcgatctttcttttcctcgtccgacatttggctgttgattctgcgttcgatttcttctcttgaggctgagtccctccccaaggctctttcgatgcggagttctcttggggcatagaccatcaagcttatgtctaccactttgtagaaaccggattcgaataatatggcggattcgatggcacataaaggggaagtctgtctctctacccaagccgagaaatgacggtttacctcaggatgaatgatctggttgacctgttgtaattgttccggattattaaagatgtggaaggctagaagtttcttgttcaatccctcattcgtataaatctccggaccgaaaagggctgttaatttctcacggataaccggggagttatttgtcagccatttactttcctcgtccgctatgtatacgggtacaccggataacgctaataaagaggctacgacggatttgccgctcccgatccctcctgtaatacctattttaatcatgcttattgttgtgttccaagataaattctaccttatctggcaataaggttgccgtatgtacccagtctggtttcttggtgagtttgacgggtagggtaccggatacgttttgctccagatcctcaaaaggtatatgaatcgagaacatatcttccgaaagtcctttgaaccgggacaagggtacgctacaagtcacttttacgaccgccggaaacatacgtaccgtataatgtggcggtatatgactgcaagagacaggtatttccagcgtcttttccgtgtactcctctattggaatcgtgatagatacgctttccggatcgaagttaacgccgtctactttgattagctgtacggttctcgtaatgtttttattcgcctttttaacttcggtgaagtccgtcttaaccgaggtcaacgtatctaagatcgccgcggtggcataagcgttgatcttttggggattgatttggatatccccggataattgaaagccggcttccatatgaatatcaccattaaaaacgacctgtatttccttatggacccgctgactgaaatccatatctatttgttgcggatcaaaactttgtaatgccgtagtggctatcaattgtttttgaatatcgttctcgatctgccttttacttacttgaaccgaaccatttttctccttcgtattcttcatgttcacttcgatcggagcaaacgatcttccaaaagtatagttgagtaaaacgctacccttgtcttttacctttgcggtaatcgtttccacctctggggcattaaacgctatatcggcaggtacgttcttatacttaaccggaaaaacaagttctatctcatattcctgctgcaagctttggagtagccagaagccgaaagccaaaagggcgaaaaagaaaaagaccaagacctctttccatctgtctccgtggaaaaaagccttagtctttgcttggatagacttgaaggaattttgtatgttctcaagtcgtgacatattctgtagttagattatttctgctgctgagcgtcttccgctgaagcgaaaatagaagttttatctacacggatacgtactccatccgctacctcgattagcatataagtatcaccgatctctttgatctttccatagatacctccggcggtaatcactttatcgcctgttttcaacgcctcacgtgatttctggatttctttttgtttcttttgttgcggacggatcatgaagaaatagaagatagctacgataactaccatcatcaaaataccggaccactgacttcctccagctggagcttgaagtaaaatactgagtaagttcatactataataatcgttttacaagttaatatcaataatgatatgcacaaatgtaatgataataattaatctttgagcaataacttctctttttttaattcgttgactattgaatccagaattccgttaatgaatgttccgcttttaggtgtactataatactttgcggcatcgatatattcatttaaggtaacgttgatgggaatggtcgggaacgataaaatctcggctaaggcgacttgcatgatgatcaagtccatattagcgatacgttcggtttcccaattcttcatatgtttgtcgatgcgttcacgatattccttacctttcaacaaactttgacggaataacttgattgcgaaagccttgtcttccaaatccttgaacattggcaataaggcttgtttgctacctttcttctcctcgaatttcttgatagtcttcaaggcgaaagtttctacgatctcgatatcgtcattccagtagatgcttttatcttccagatattcctctatcatctcgtttccacagattattttcttgaagatctggcgccagaactcacgatccgtctcgtacgagtcttcttcgtttttcaagtattcggcgtaaatctcagaacttaagatcgtatccaatacgttcttaatgaactcctcgtcgttgctccatgagagaccttgctcgtctacatactttttcaacgtatcgttttccgctaattgagcgacgaaacgattgtctatgaagcgtgtattcgggtttaactcctcgtcggtaggcatgtatttgcacttccggatgtcaaggatccttctttgcaggttggtaacttcgataattaggagtaagaaataataatataagtcatatgacttctgaaggctgaaaagcaattcgttttccgcaactttgaggtcaccgtttccgttttgatagtaagagtatactatctgtaaaactttaatgcggattaaaattctgttgatcatcgtttgaaggaacttcttattataaattaggctgcaaaggtagtcgttttttccataaaagaatccggatttacttaattttatatgtgttagatgatattttacaaatttagcctcaatgggcgtattttcgatcgttaaaatagttgctaattaaaaaaaaatgcacatatttgaagcaagttatataaagtgggtgggtttttaacgaatgttagctgtcatggaagaatcaaggaataaaaaacatgttgaaggtggcgacagggagattctatactctaaagccattaaagcgggaaaacggatttattatctggatgtgaagaggaatttaaaagatgacctattcgttgccgttacggaaagtaagaaaattcaatcaaaggatggtttgcaaatctcatttgagaagcataagattttcctttataaggaagactttgagaagttcatggagggaatgcaagatgtaatcagttatatcaagaactcaaatctgaagaaatccgcggaagacgtggtggaacctgaagaggaggaaacgattcctggcgattccccagaggaggatatgtcttccggtgatataaagttggatattgagttttaatgtaacacgaagagaaaaagataacgggctgttttactcatagagagaaacagcccgttatgtgttaggagctttccgcaaaggaaaatcctattctttgctgcgaattattcagccgggtggatagcctctgtaggacatgcgtcagcgcaagttccacaatctgtacacatttcagggttgatgctgtatttatcaccttctgaaattgctcctaccggacactcatcaatacaagttccgcatgcaatacaatcatcgctaattacgtaagccatttttttaaacgtttaaattgataactattagtaggtgcaaaaatatagctttctttctatttaaaaaatatctactggcttattttcttcaaaaatcttcttttttgcaatatctttgtcgggttttcgttattaaacaaaataggttgagatttgagacgattattacttatattatatgtggtaagcttggctaccatgggagccatggctcaaaaggaaagggtgaggaatcagccgtacgctgatttgaaatggcttcatctggggtttcatgtgggtattcactcgcaggatttgttattgacccataccggtgtcatgaccaatggagagacttggtttgcggagattccttcttactcacccggctttagtgtcggggtgatcggagatatgtatatgaatccttatttcaatttacgtttcacgccttctatccatttcggagataagaaatttaagtttcgggaacaggctacgggagaggaattcatcacgaacgttcgttccagttatctgaatttccccttagacgttaaatatacggctttacgcttgaataattatcgtccttatttgatcggcggtatctatggctccgtggatataggccgtaagaaaggtaatccgattctattgaaaagcacggacttcggatttgagtttggcttgggatgtgatatctatctaccctactttaagttatgcccggagctgaaattctgtttcggattggttaacctattggagaaagatcgtccggacttggtagatcaagcaaatatcaaatatacggatgccttatcgaaagctacatctcgtatggtgatcctgacatttaatttcgaataaataactcgatatagatataagcggccggtatagccatcattacgctatcgaagcgatccagcatgcctccgtgtccgggtaatacatgcccggaatctttcacgcctagcgtacgtttcatcaaagattcgatcaagtcgccccaagtcccgaatactacgatcgtgccggctaatccaagccatgtgtaccagtttgtggccggcatgaaccaagcgaatatttgggaggttattaatacgaatgccaaccctccgtaaaaaccttcccaggacttcttgggagaaatacgttcgaacaatcttctttttccaagcatagatcccactagataagctcccgtatcatttacccatacgaaaacgaaaatagccaaggcaaaataggggatatgtacgatctcgcccggcgtattaggtaccgatgtaataaagtttagcagagagaaagagcctgcgcaatagatttgaccgaataaggtcaatgcccagttattgattggattactggctttatcgtaaagctcggtgatcatggtatacattaagaataaaagataggggagaaatatattgcctccaaccaagccattggcgtaaccgaatgtggcggcgaagaggtaggctccccccaaggaactgacaaatcgtttgatggcggcattctcataatgtttgaccaatccgtagaactcccatagagaaagtccggtaatgagtccaaataccgtaagaaaataataggagtggaaatagatcgcaccgaccaataccgcgacgaaaatgatgccagtcaatgcacgtgtaatcagatttttcaaaacaatagtgtttttgcttgtttgtaattttggctgcaaatataactaataaattgataatacagcaataagaaaggctggatagtaacttttgatcaaagatacgccccagccttacttgttatgaatgtcttgactttggtcaagctattttccctgtcttgttttcttcggtaggagtatcggttacgttttccgttgttgcgtccgcttccgcctccttatccgcattctccttgttctttccgttagccttttcctgcaactccagaatctcttgggaacgggagatccaggctcgtttcccgaagatatgctctacatcttccgagtagattacctcacgatccaataatacctgcgcaagtttactatgtccttccttattctcggataatatccgttttgccctgtcgtattgctcattgatgatcttctgtacttccgtatcgatcaattttgcggtctcctcactataaggcttggtgaatccccaatcctgtccggtggagtcgtaatagttcaagtttggaagtttatcgctcataccgaagtaaacgaccatcgcatatgcttgtttcgtgacacgttccaaatcgttggatgcgcctgtggatatttttcctaggactaattcctctgcggcacgtcctcctaaggtagcgcacatctcatcctgcaattgctcgcgggtggtgatctgtctctcttccggcaagtaccatgccgcacctaatgccttaccacggggaacgattgtcaccttaaccagcggattggcatgttccaacaaccaacttaacgtagcgtgaccggcctcatggttcgcgatacatttacgttcttcctccgtcgtgatcttcgaacgtttttcaagaccaccgacaatgcggtctaccgcattcatgaagtcttctttctgtacgaatttctttccgttacgggcggcgatcaaagcggcctcattacaaacattagcgatatcagcacccgagaagcccggagtctgccttgctaggaactcagcgtctacgctttcatctatcttgatcggacgcaaatgcaccccgaatatctctttacgttcattcaaatccggtaattcaacatggatttgtcggtcaaaacgcccggcacgcaacaacgctttatccaaaatgtccgcacggtttgtagcggctaaaataataacaccactgttagagccgaaaccatccatttcggtcaacaactggttcaacgtgttctcacgctcatcgttgctattcatgcttgcgttctttccacgggcacggcctaccgcatcgatctcatcgataaagacgatacaaggagatttttccttcgcttggcggaataagtcacgcacacgggaggcgcctacaccgacaaacatctccacgaaatcagaaccagacaaggagaaaaacggcacattagcctctccggcaacagccttcgccaataatgtcttaccggttcccggagggcctaccaacaatgcacccttgggaatcttacctcctaattcagtatatttttccggattcttcaagaaagagacgatttcctctacctcttgtttcgcttccgccaatccggcgacatccttgaatgtcaccttacgatcattatctttatcaaaaagctgagctttcgccttaccaacgctgaacacgccacccggacctgcgccggtaccaccggacatacgcctcatcaagaacatccatacaccgatcaataagataatcgggccgaatgaaaccaagaaattccagatagcgtcatcgccttcctcgaaccggacttgtgtatcgatatggctatcggctaccgctttgtcatagaaatcagaaaatttgtcggccgatgggatctttacgtatactttcggagagaccccgattttcgaaatgtccatattcccgaagacctgttcagtatgtccgcttttcactgtcgcctccaccaagtttttcttgttgtagactgtcattttatcaaatacgttttcttgcgctagtttctggaactctgtccagcctagctctttcgtacccgaagaatcatttgtcatgtatagggcaacaagcatgatgaagatcaacccgtacatccaatacaaattaaagcggaacatcttaggtttcccgcccttcggtgttttattaaatatatcgtttttattttccataagagattatcatcaaatatttaggccggcttaatcaatgttaggtacttgtataaccttcgagtctgcccaaaggttctccaagttataaaatgcacgttgttccggcaagaatatatgcacaagaaccgtgccataatccatgccgatccattgagcaccctgtgtaccgtcaatggataatggtttctcgttcgcgttcttgcgtgcgaaatcccatacggaatcagataacgctgaaacttgggtaggagtgtttccctcacaaataaccatatattgacaaatggcaccagaagtctggcttaaatctactgttacaatatttttgcctcttttttcttgaaggccttcaacaatcgtttttactaattcttttgtttgatccatttatttctattgatataattttccaagtcgcaaatatacttcttaattcgttacatacgtctttttctttcattaatatatgtgtaataccttgtttgagactatctcctcgatcgttataagcttttaaaaaaacacgtacgtcttttttctggacatttttttcgaaggtttatttgcaaattttgaaaaagtatatacctttgcactcgctaacaagagagttagtgatttgttaaatattgttctatggtgtaatggtagcacaacagattctggtcctgttgctatggcaccatcatgtcgttttgtatatcgttgtttcgattacgggtgcaaaggtaggtattatttttaatccagcaaatgttttgaaagaaaaattcacaggacagtaaattatctatttttcctgcaaaaaaatccacttttctcttgcaggttcaaaaacaatgtgtacctttgcacccgtaatcgagacaacgatacaaaaaaacgggatgtagcacagttggctagcgcgccacgttcgggacgtggaggtcggaagttcgagtcttctcatcccgactcatcaaaaaggcaagaatcttgaaagagatcttgcctttcttttttcaatcccattaatatctaatgaataacaaaaggtatcaacatatattgttcgatctggacggtacattaaccgatcctatgattggtattaccagttctgtaaagtacgccctctcctatttcaatatagaagtagaagatttacgatctttatgccctttcatcgggccaccattaaaaacatcctttaaggacttctatcagtttacagatgagcaagcagatgtagccattgctaaataccgggaatatttttcaaaacaaggtattttcgagaataccctgtatcaaggtattgacgaattactccgtttgcttaccgaaaacgaaatgaaaatctacttagccacctcaaagccgcaacccttcgctcaacaaattctagaatatttccacttagaatcttattttacatttgttggaggaagcacattcgacggaagccgttccgaaaaagcggatgtaatacaatatgtattagacagcaccgatataaaaacacggtctgacgtagtcatgatcggtgatcgtaaatatgatatagaaggggccaaagcgaataacatagattcaataggaatcctttacggctacgggaatgaagaagaattagcgaatgccggagcaaacaaaatcgttactgatataaaagaactatcatctttccttctaacagggaaatccccatatagaaaacttaagcagatctataaatcacattaaaaataaacatcagcaataaagagaatgaaatatttggaaagctcggcttcaaccgggctaccaatttttctatagcgatcttcatctgtacacgaaccgtactctcttgaaccgataatatttccgcgatctccttcgttttcaatccctcctcacgagacatcaaaaacacaagacggcatttctcaggaagttcgtcaatcgctttatcaagcatctctctcatctcttttaactccaaatgctcctccggagaaccctcatcttcctcttccattaatggcaacaactcatttaaagaaaccctattcaagtctttattccttgcttgaaaacgaaaagactcgttacgtacggaaatatataaataggtatctatattatcaatatcctttaatcgtttccgggattgccagaccgagaaaaaaacatctgtcacaacttcacggcatgcctccttctcgcctaaacaataataagcgaaacgaaaaacctgatcataatataaattataaaaacgttcgaaagctcccctgttatctaccgacactgattcaagcaaccctttgatatctcgcacaaaaactcccactcctttttctttgatttggcaaacatactaaatataatctaaatgcctttttaaaaagcagactattttttctcatattttacttgcatattcaaattattaaactacttttgcacccgcaatacggaagtagctcagtcggtagagcactggtctccaaaaccaggtgtcgggagttcgagcctctccttccgtgctatggcaccatcatgtcgttttgtatatcgttgtttcgattacgggtgcaaagatacggacttttttgatatatgcaataggtggcggtggattttttgaaaatatttgagggtagaggtggaattagctgctataagcagggtaaatagggggagcgtgtagataaatatggatttttacttatttttggaagcgggtagagaatgattaataagctatagatatgaagaaagtaatttggagtattgttttaagttgggtatgtttggcatttgctgctgctgggataggaactcgtgatgcggtgtctgcctgtgatgggaaagtgtataaaaaaggggataagattatgtttggtgtccctaaggtttccggatatttgtttgttaggacgtttacaaaggatgggaagatatctacgatgccgaaagagaatctggctagtcaagaggcggtgatcgttgatattccagattacgataagaaactctttgagggtatgggcgtttattctgaggaagaaacgcatcctcttgtcgtggtagagctggatggacggcgtctttgtataaatattaatgatgcgcttagtcaagggaatattgtttcggaatattttaaaagcgaagttgagggtgtggtcgatttaacgtccgatctcttatttgtttatgcgcttaaattaaataatgtgacagttgatgacgatgtgatagtaaggtatatggctcattgtgacaagaatctggtagagaaaaatcaagcggatccatttactatggcggatcttaagaaagaatatgccgctaaattggaaaaggcgttaggggacgttgattttagtaaggtgtttcgtattgagagtcagtcggagatgttacaatatgatatggataagcagatctttccattaaaagggttgtggtgcccacaaattaagacagaccagccggatgcgttggctaagattggcttttgtaaatgggatgattgtgtctttcgatttgtgaatataccagagttcatgaatgtctcttgtgagacggctcgtgcgaaagggttttatgatatgaggaaagtcggaaaagtgcctacctataataagccgctggctacctcttatacttatatccgtttcttggataagaaggtacagcttcccgagaaaaagaataaggtctatcataacggtgatataaagagtatgtctttggctgatttgtatgggaaaatggctatagaggctcaaattataaagatggatgtttatcacttacctttcttgaagataagtgattttgaactcttctataattatttaggatccattgaagtgaaataataggaaaacggtccgtccccccataaaaatgagacggaccgctttgcattcgtgaattcagagcggatatttctttttagtttagtgagttccaaccttgcgccttaagctcgacttcacctccgtcacgaccgacaagataattgcctaactccggctttgttatatgaccgatcaccttaatacctttcatttccgacaccttatcatgatctgctaaaggaacagtgaataagagttcataatcctcacctccattcaatgccgcggttatcagattcatgttaaactgctctgccatggctgcggtttggtaatcgataggaatacgatcttcgtaaactcggcagcctacattactttctttagatatatgaagcaactccgaagagaggccgtcggagatatccatcatggaggtcggaacgattcctgcttggtcaagaacctcgacaatgtctttgcgggcttccggttttaattggcgttccaacaaatattctttaccagagaaatcgggcgtgaaatctttctccccattaaatatgcttttctcccgttccagtaattggagacccatgtaggcggcccctaaatcgccggacacgcaaataagatcggtctccttggctccgtttcgatagacaactttgcctttctctccctcgcctaggcaagtgatgctgatcgctaaccctgtgcgtgaggcggaagtgtcgccaccaacgagatctacgtcatagatatcacaagcgagtttaatgccctcgtagaattcttcgagatcttctacacagaaacgtttggaaatacccaatgataccgtaatctgtttcgggcggccgttcatggcgtaaatatcggagaagtttacgactgcggatttatagccgagatgtttcaacggcacatacatcaaatcgaaatgaataccttctagcaaaaggtctgtcgtaaccaatacttgcttgtctgtgtaatctagtacggctgcgtcgtcaccaacacctttcaacgtactcggatttttaagttctattttatcggtgagatgacggattaacccgaactctcccaaagtcgatatttctgttctattgctcataagattgttaacgtaatataggatgattctttattcttgtatcaatatgtttaactattaattcttgaaattgtttttcccggtccatacagaaacccaccgtaataggcaaacaatataaatgagaaaaccattccatgggaagcgaaggaaggtcacggagtcgggcggcatctttctccgtgatgattatcaatttacttgtagaagtcaaccgcttgaaggccgtttgtattttctggatgtcatgccgatcgaaggcgtgatgatccggaaagatcaatgaggtgacatgctccgtatatttatggatctctttttcgagaggtgccggggatgcgataccggataccaataaaacctctgtagtagaggccagcccttttaatgtgcgtctgggggctttaccggaaaagacgggttccagctccccgtaaagaatacggctgaaatagagctcttgataagctgagagatgtatatcctcctctatgatccggaagtctataggttgtatacatgactcacatttcgtgacaatgatcacgtccgcacgtcgagcgccattcacaggttcccttaaacggcctgcgggcaagagcttatcttgcgtataaagacggtggcaatcggttaaaaggatgttcagcgtgggggcgacgtatcgatgttgaaaggcatcgtccagcacgatcacttccgggcgcttattctctggcagagccaatagattgcggatacccctgcggcgatcagcgtctacggcaacgagaatatctggaaacttacgtttcatttggtacggctcgtcaccgatatccttgctggtacttcgctgatcggccaacaagaaaccggaggttttccgtttatagccacggctgagtacagctacccggtatcggtcttttatcaaacggatgatgtattccgtatgaggagtttttccggtccccccgacagtcaggttccccacgcaaataataggcagatcataccgctctgtccgaaggattttccagtcgaacagctgattcctgaatctcaccccgattccataaaggaaagagaatggagtgaggagtttattgaacttaatcgtatgatctgtcagcatggcccagttattataacggtttcatatcataaggcatacgagcttggattccgcaattcgtcttgatattattcaacgtcttgaagtactcgaactcattacccaatacatttttgacgatagagagtttcacctctccgagctggctttccaagaactcgtccaagaaattcttggaaccgctgacggtagttacgctatactgatccagatcagccaaccccgccgctgtgcttatagctaattcaataccgcccagctcatcgaccaaacctctttctttcgcttgctcacccgtccagacccgtccttgtccgatagcgttgaccgcttcggtagtcatacctctaccttcggcgcagcgggaaaggaacgtttggtagcctctttccacgtatccctgtatcagtgctttctcactctcggtcatgggacgggagaggtctcctaagtccgagaacgtgttcgtctttacgatgtccgtggtcaacgctagtttcccgaataatccggaggcgttcgggaacatgccgaagataccgatggagccggtcaacgtattcggttcggcgatgatcttattagcggcgcatgagatatagtagcctcctgaggcagctacgttgcccatggaaacgaccacaggtttcacctttttcaactcgacaacttgacgccatatctgctcggatatataagcgctacctcccggggaattcacacggaataccacggctttcacgtcatcattgttttttagcttgataagctcatcggccattttctccgtgatactttgttcgatatcgtaaaagttgccgggtgtttgcgccttaatctcgccttcggcgtaaagtacggctatctccgggacgtttttggtgggtgaggccttgagggttttcatttgagctaagttggccgatctcagtttctctccattttgtccggctaactctttgacatatgcttctacctccggcttatacttcaattcgtctataaagccacattctaccgttttcacagggtccgcgaagaaaagcccctcattggcgtaatggttgatatcgttcacgctgataccgcgtgattcggcgatgccttcggctatattatcccagatggtggagatatacgattggatttgctcccggttcgcctcgctcagcttatccagcataaaaggctccacggcacctttgtaggtacctaccttaaaaatctgcatctcgatacctaccttatccatcagtcctttgtagaatagggtttgcgaggcgagtcccgtcaattcaaggatgccttgcggattcaagaataccttatcggctacggaacaaaggaagtagttcccttgcgtgaaattatcggcgtaagctaccacgaacttgccgctttccttgaagtctatcagcgatcggcggattgcctccaagctggcgctacccgaggagagaagccccgattcgatataaatccccgcgatcttgtcattctgtttcgctatccggatcgtctcgagcaggtccttcagtgacagcatgttttccttgtcgcccatcaaggcggagaatggattctccgccgggttatccgctagcgtcccgtctagcttgatcttgaataccgtattgcttttgggggtgtaatcaggtgtgctacctacggtggcgatatatcctatagtcatggatatcaataccgtcaggattattcccattgccaacataacgcctagcgttgaggcaaacatcattttaaagaattgtttcatatctattgaaaactaattagatgacaaatgtacgaaaatttcctctacgtcccggtcgctgaggcatacttgttggtaaacatctcgcagaagctccgggttgatcttcttgaaatccttttctaaaggggtgatgaaaagacctccgatatcggcagctcccgggctggacaggagatggtcgtcgccctcggcctcgtattgccacgggcggtggcgtttacgagggataaccgtgattacccaattattatcgtaataggagccgaagatattcatcatcggctcgggctcaccgggaagtatcggcaaagcggcgtagatctttttgaagagccgggtggcggcttcttcggtggcggcttggatgacgaggccggggcggaggttgccggtgagtgggtatatacggttgtcgtatacactcgcatacgattgtcgtataaattgggttacctcttcatccagtggcatgatgcctcgtgtcaccgcttggaagtgggcatgatccggtgccgaggctccgctacggggtccattgtagaagacggtgaagggagcgagtctccttgtcagttccaagaagtcattccattgcggcaatatcagttgcggagtatgtttccgggtagggatcgtgaaatgctgggggaagatcgggtaggggttgcacaataccagatggcgaaagccgaaaggcagtcgctcctgttccaccggcaggttctcgggacataggaagcacttgcgttcttttagggatcgggcatctaccttggccccggtggaaacaatacgggcgggattgaattgcgcacgtatcgagaaccctcccatatcgaaggattttacttgcacggcctccagcgccttatagttcttctcggccaatggccatgtcacgagttgcttggctaataattcggtcgcttgcgatgagctgacccagttgtttggtttcattgtctttccatgtttaagcgggcctcgagttcccaagtcctgattttatccttatatatattatggttgttcattttcacgacatccaatgaggcgtcggagttatcttcccaacggcggcaaaggtacagcacgtcgtagatccgcccgatcgggtactcgcggctgatgcgcaggccgagggcgtaatcttctccgtaactggtgttcgggaggtttagtttccgtagcaagggtgtataaaaggctcggggcgctccaagcccgttgatgcggagggcgttattgcggccgttctcgggagtccattctttatggtcgataattccgggcgggatggttcgcatatcgaaatcggtcattcggtaggttccgaccaccatggcgcatcgctgctcgtagaaggcttccacgatcttacgcagggtatgctcgtcactgtatacatcatcgctatccaattggatggcgaacttgccgcaagccgaatggtgtattcctatattccagcaacccccgatgccgaggtcgtcacgctccggctggatatggataatacgagggtccgtggcggcgatcgtttggattcgctcggaggtgccatccgtagaatgattatcgataatgattaggttgaaagggaaggacgcctcttgtcgcagtacggaacggatagcgtcctcgatcgtccgtacacggttacgtacagggataataacggaggcttccgtttgaaatgtctgctcgtcaaaacggactggcttgaaatgagggggcaagtagccgcctatcatctttaagtgatctgtacaggcggcttccatctcgatctgtacaaagcggttcttgggatctacatagtcgaacattttctctccggatttccgtaaatcattctctacttctgtatatagatattcgttgatatgcgtcagcggagcgttttgggagactttcaggcgcaagtcgtagagtccggcgaatgtatattccgtatccatggaggctatggcgttttgtagcgtggaagaacgatagagtaggagggagccgaaattgaaatcatccctaagacttcctttctggtaatcgatcaccggatggggggtgagtttgccctccttcttctcgtaataatcggagtaaaccataccggatctcgtatcgtcggcgatggcgacaaaacgctctagggcatacatgcctaattgaagctcttcagtcttcgtataaattaacgtataatgggcactggcatagccggctatttcccggagggtcttcgtgctccatatattctccgtgcggattaagttgcagggataaatagccttggcgtggggatcgtccgtgattagatagatctgactcactaaggacgactcggccaattgcgctaccgtttgtcgtgtagcctctatttttccataagggataaagcaattgattcgtttcattgtatatactgtattttattttgttgttgaatggagaaaaagcgtaagatggactccatgagtcgatttcgttccgacgatgtttgaagcgcctcaaacgggaaaccgagcaaacaagtccgatatttcccttcataaacgattcccgccccgatattgttctccggatatctcaagatggtatgggcgagcttatccgccggaagtacaccgtctaccgactcgatcgagtagcaaatagggttcggacgtgtccggaacgtgtatctgccgtttatatatccgtaaggggatgcgcaactgtttacgattccctccttgctggcattacggctagccaacttcccttttagtacctcctcgacgaacgtacggtcttgtgcgttgccccagctgtcggagaaaagattcgtcccgcttacaagcaagttgccgccttgggcaaggtaactgcgaagcgtatcctgtaaaacgggagtgataaccggttggcgctgttttcctaaaatcaagtcaataatcggatacgtatccggctttacgactccctcggccaaagatttatggctacatgaaacaaaggaataaccggtcccggccatggcctgcccatgtatgaaaggataatcgaaggtattgcccgctatgacttggcctgcgtaattgttgtaactatccccatgcccgttattatcattgctgttccatgtggcggaacggcggaattcgaattgatccccgataaatgcgatatcattcagataaggcactccccggtcgacggcataaagaaagccggctaaactatccgccgcactctcgaaactggctggaccgctgatcctgtcgaatccattgacgattaataccgtcttatccttttcacctttaggagaccggtaaacacttacgatctcggaagggaaactgatgcctcccttatttacggcagctaccttataactatggataatacccgtctcaattggaagaatgatttcttctccttttacgagcgtcccgttatcgaatccaccgctgtcttttcgactataaaggatataggcggttggtgaggcactctcctcaagagtatcctgtacggctttccagccgattctcactttattcgtttctacgaactccgtatacagacgatcgggtgggagcggttgtacgataggctcctgtttattctggaaacagatataacggagcatccctttatagatcgccctacagataaggaaacggaagcgtgggtctaacccgtaacgcatatcggcgaagttttgatgggatagtaattctaatagcatcgttgggacatcgggaatacgtgcctctatataagattgattccacatgccccggcggctccattgaggattgtaaaccttgcggacatcggacaggatctgtgtttggatcatgtcggttaggtctctggcgatctcccggcttttccggttggtgtagattccgtcgttgcttttagacatatagatgccgagtgtccctataattgagtcatccggggtggttcctgcgtcggaatggaatgcgaaggccatgtcgatagggatatgggtctgttcttttaaataattaacccatcggggacgtgcgtaaatgtcgtcttgataatcattgcggaaagtgcttttcgaatagatactatccggtattcccgcccattgtagccaatatcgggccgcctcggtaaaccgtggatacccacttgtctctgcttctatcggatagggactttctagcgggctacgtgcgatgttccccatgccgccaccgatcttgattgcgtctgccgtgataatctttcccgatttattgctttgattcgttaatacgattctctcatgggcttgttcatgtgccgtgaatttgaagtttcccagatagatccaagttccaccccccatcgtttgattgacggcgatcgtggtttcccctccggcatgatggatggtatacagtgcctgctctgtgctgttcggaaaagattgataggaggcatagaccgcgtaattccccgattccggaatttcgggaatccactcgatgagactttcttttcctttcctctgtgtgaccgtctgccgataggtgccttgcgtaaaagggttctccccattcgtataagtagcttgaatatgcccaaatccggctttctccccatccgaccaagctttctctccatccaattccttatactcggatcccggagtagagcgatcattgtcgataatgatttcgtgtatttgagtgtccctttcccgggggataagaatagtcgctcctgcgttttcaagcatcggggtcagataaggaagaacaaaactctgcgtaaataagtcctccacggtgccgaacatgcgagcccgttgccattcccagcgatgggcggtctgggcgtaatataaaccatggctttgccaaagggcgatatgacggttttgtaatccgttttttatctcatgaggggtggataggctacgggttagcgggtatttactctctttaatggagtatagcctctttttgttgggacgtccttttctgtcgtattcgggaatcaagctctcaatgtctgtatctcgggtcaagatgacgatcttggaggcattggggaataggggagctatacttgcgtaaagctcagaaacgttatattcccgaaaagggatgtcctccaaagcttcattggtgaaaagcgtgactttcttcttctgtatgaggatggagtcaatcttaatggtgcgtgaagacacatattgccttgcgaaagagtttagcttttgatccaattgcttttttaagctttcactatcctgcccttctgccggaaagctccagagaaaaatggatagtaaggatatgatgatcctaacaggataggagagtttttctcgcatatttttataaatattattggctgtcttatttctacaaatttacggaaaatctccgtaataacctcataaaaagcccagattggcgcaattaaaattgaatatgaagaaggtaggggcaaattgtggatattgggagaagtcaaatctatgtgaacggcagcaaggagaagaacggatttgtccctatcatgggacgggtagcgattaacgggacgatggtgcggttcagttcagttgcgagcgaactattcgtgttcatggtcaagacgcctatccggggaatggttattccttcttgaagtgtcgggtttgcgatagtatctcaatgggaaacggtggtaaagtcaatgggatagaggtgttatctcaatgactttacggccgtgtcccataggctttttttgtatcccggataagttggtaggggatggttcagggcgcaaagggcgcatctttgcgaggtttgtaaaacttttatattataaaaaaattagcgtcttacttatatatagatggagtaatatattttttttgtaaaatgtttttgcgaacacgtaaagatgcgccctaatgcgccctgtgattttttttgaagattttcttgatgtcttaaagtatagatagacagttgtttatgtaatactgttctcttagcctttttttagtctttggggcgatataatcggcctaaactcacatttacgtggcccaaaagcacgtgtacagagcgattttctcgtgattccatgagcagaaagccgtttttcccgtgtgatttcctctcgtcgctaggaccctgtttatcgtttttatacgtgtaaaagcactcgtgagagccctgttttcggtacacgcggtgactcgtaagttaaaaaagagcatcacgtattatttaatgtacgcaatccccctcgtgaaaaaaagcctaaaaaataatgcccgataaatttggatcgtatgttttatagcattacttttgcacccgcattcgagagagaacggcgcttcaagttctcaccgaactacgtcataatttattgattaattatctcaacgaaataaatttatatcccttatttttcaatacatctatcaactcatccagataattatagaatttatcaatccggttagggtgtacatgtaggtggatcaaaagtaagcacccatttaaaccatttttgtttcataaaatgaaattccattatatatcatatttatttaatttcaagaagctttcctcccatttctgttaattccgatttattacgtacctttgtattggtttttaagaaggtaataacatgattcaagaagcgattatccgatatctgcgtaaacacaggcaggaatccctttctcccaaagctgttcttttcgatatggatggtgtattatatgactctatgcgttttcatgcacgggcatggcatgaggtagcgaccctccatcagctaacttctcggccggaagacttttatatgttcgaaggacgtactggggaaagcacgatcaacgagctataccaacgcactttccaacgagacgctaccgccgaggagaagcaaacgatctataaagagaaagcggatctattcaacacctataatgacggtgcccccatgaccggcgccgcagaggttctaaaagaagtggaagcatccggactgcaacgattggttgtcaccggttctggccaacatagcttgatcgataagctaaaccatacctatccgggacatttcaaccgagagaaaatggttacggctttcgacgtgaaatatggcaagccacaccccgaaccttatttaatgggacttcaaaaagcgcatgcgaagcctaatgaaacttttgtggtagagaacgctcccatgggagtagaagctgccgtggcagccaatatctttacgatagccgtaaacaccggacctctccccgatcaagttttattagatgccggagcggatttactatatccggatatggaaaacttagctaaagattggaaacaaatcatcgagcttgcgaaatccacccgattgaacgagtattccaaataagcgaacataaaaaaagaggctacccgataatgaagtagcctcttcttttttatcatcgaacggattatttcacataatcagccttattcaagaaatcatagctttgctgaacgctggcaaccggatcattgttagtatattgttccacttcaacataccaatcctttacgttattagcgtacatttgatcgaagataggcttgaaatccatcttaccgcttgcgccgatctctttctcatccttgatatggatagccttgaactggctcggacggttcttcaagtaagcgacaggatcaccgccacccatcattacccagtatacatccatctcgaagaatacgtggttcgggcttacgttatccaacagataatcatagatcaactgatcgtcaatcttacggaactcgaagtcatggttatgataaccgaatgcgatactagcggcagcggtcttataaccaaccgtgttgaaataatcacagtacatcttcaagtcatccaatgtagtcttatcgttaaccggcatccacggttgaaccatatatttaacgcctaactcattatgagcatcgatcgcttgatcccaccaactcataacctcggcttctttttctttcgtaaaggcctgtccaaggtgagcgctcgtgcacttcatacctaggtcattcaccattttcttaaattcagcgggagctaaaccgtaaatcttaccgttatcatagcttgctgtctccagattcttataacccatcttagcggcggtttccaatactttctggataccttcttcttttacaaggtctcttaaggaatacaattgaagccctatatatttagaagactccgatgctgtagcggcagcttgtcctgatttaccgccacaagaagataataactgcggggctaccaacccacccgcaagcatcaaagaggcttgcttcaaaaaattacgtctgttctgcatagtactattaattaagtttgattgagaatttttacaaaagtaagactatattcttaggtttatatctttatggaagttaaaatcttcaaaaaggacattgtattttaattttcgttatctttggaggatatattattacttaaatcatttatatcatgaaaaaattatcaattctagcgatgggccttctctttgtcctgaccacagcctgtagtgtttctggcagtggcaccttattcgatggcaaagatagtaacaaatggaaaatgacaggcgatgtctccgttcaagacgacataatgaccttgaaaggtacggatgcgctggtcgtactgaaaaacggcaaatacaaaaacttcgatctgacccttgatttacgtactaccccgggaggcaaaggcgccgtctggttccatacggacccgaacttgaagaaaggatatcgtatcgctatcaataatgaccgggctgataaggtttggtggaaaatgacaggaagtcttgtttccgtgaggaatttgaccaaaagcttcgtaaaagaagatcaatggttcaagatggatatccgggtagccggacaagagatcgatgtaaatataaacggcgaaccggttgtagagtatatccaaccgaccgcaccgtatcgtacggacgctaacacctatgccttattatcggaagggacatttggcatagagagtgatggtagcggtgagatccagatcaagaacatcaccgtgaacgtaattgatgaatccacgatcgatatcaacgcacaattggcggaagctaacgatgagcaaaatgacgagatcataaaattacatcaatcggatttccctgtattggattatcacgtgcatttaaaaggtggattaaccaaggaagttgccgctaagcaatcccgcaagaccggtatcaattatacgatcgcaccgaactgcggcatcggtttcccgatcacgaacgaccaacaagtcatggattacctaaatgagatgcgctcacagcctttcatccttggtatgcaagcggaaggacgcgaatggataaccacattctctcccgagactcttaaagaattcgactatgtgtttacggacgctttgacgttcaaggacaataaaggtcgccgtacccgcctatggattccggaagagacttggatcgagaatgaggagcaatatatggacatgatcgtagatcgtatctgctccgtattggaagagccggtagatatctatgtaaatccttgtttcttgccatctccgatggataagcgttttgacgaattctggacggaggcccgcatgaagcgtttcgtcgaggcattggctaaaagcggaaaagctttagagatcaacgaactatacaacattccaaataaagcgatcattatgaaggcgaaagccgccggcgttaaattcacgtttggaagtaacaacgtgacaccaaacgtcagcgatctgtcttacagtatccgcatgatgaaagaatgtggcctgacggctgaggatatgtataaaccgaaagttaaaatctaatcacactttaccctcaccctaatcccccgtttagggacaccctaaatgagtgattagggtagacctaaacgagggattattctctctctcgcaacatccgtcgcatcttcatataccgatattgcttaataatcatcttgcggctacgtatgatctgataacggtaaatgatacaagacaagatgaaatatacgcccgcttgaatccataatacccgatattcatgcgccacctcatgcaaggaagcgcctgccgtattgatacgaataaatccctggatacccggagtagaaggaaacaaataacccaccactttccaaaacggaggaatagccgcctccggccaagagacacccgagataaataacaagatgacagacgtgaaaacgaataccaacataggtgactcacgactcgtcataaatccagatagcgtcatagacataaaaatacaggcaaacaggtaaggcagtaaaaacaacaaaatagtcagtggctcaccaacctgaggtaaggagaataacttagggacaatagccaatacccagatgcaaaccaccacatacagcaaaagataagtcagcgacttgccgaacacgatacgcaaagtcccattaaaatgccggcaaataggcaccagactatgaaagcggttcttttcccgggccgttcctcccaacattccgatacccaatatcaaagtctgttgcaacaccaagatcaagatagccggtaccaagaaactggcaaagccattctgggaattaaacaacgctaccgattcatacgggatcgggtctaccgtgatctggtccatcttatccgtagacgacggattattatgcatccgaagttccttacccatatccaatgacacctctgtcgtcgccaaaaggaaagccttataaaacaataaggcgctcatatcgcaatacaacgagacggttgtctgtcgcccttcatgcaggtccttactataatccgggggaaagaacaaaattccataggccttcttctcatctaacatcttcttggcttccgccatatccggacaaacacccactacttccacatccggcgtggcgttaacccgtctggtaaactcacgactcaaataggaatcactttggtctaccaccaccatcttcgcctcgtgtactacctcgttattatatataaatgaataaagcagcggatatacgaaaggcaccaagaaaaagaagatcatgacccccgcatccttaaacacgtttctcaattcatctttccaaatataaaacgtatccagaagaccttcctttatgatatatcgtaaacgatgttctcttttcatcacatacagtttttacggtagatatttgaaatccaacaacgccctcttcaagttccgcccgataaggaacggcaagatcagaaatcccaacaaccaagcgtactcgcccaacgtatagaatagcgcccgcccgttcaaggcttgatcgacataaatcaagaaataatgccgcagaggaaacaaacgtgccaacgcttgcaacgtagggtccataccttgtaccggaaacgagaatccgacaatggagaacgagatcattccgaacagactggcgaagctaagccctaaacggggagtcggtaatacgccgatcataaatacgcctaccgcctgagaggatataatcagcaaaaacatcgccaaaagcatcggaaaccaaccgctatttaacgggaaagaattaaatccatacaacaccgcacaatacataaagcctacgaccgtaaaaatagccgtctgcggcaataactttcccaacaaactaactgcgatagaactccctcccatatccaaccatttacgggatgtggaatatttaatttccgtaccgatactgaatactgtcactagaaataccatcaactgaatgatacccggcaaaaccgtattattcaaatataccgaataattcaaccacggattgccgatcggatgcgtatcgatcacgatcggttgtagctgtcccatgatctgcgcttcggtatatcctttagcttgtccggtttgtaaacccacagcggcccccgccaatactgacatcgttttcatatcccgaaacagcaaggaagcggcgatcaaataggtaccattcgtatagaaagacaaccggggctgctttccagatgtggcgtccacggcgaaaccggatggaatgtaaaaaattccatatacattccctttctgcatttcctgacgagcctcggtaaacgacatggttttcatatacacctctgtctgctcaaaggcatccaactggcgaatcaaattgcgcgaggtagcagagttatccatatccaccactgctatcggcagatcggtcggcaatccctcatgcatcaacgatacaaagaaaatgacacagatagccggagcgatcagcatacaaaagaagtaaatcggttgagccaccagccgatgcacctcacgcttcgcgataagccagattctatgcaaactttctttataggtcatacgatctctttcccttttttctttaagatcacggacattcccggacgaagatcagcgactttctccaacggacgggcacgcacctcgaaagtcttcgagtcatattgtccattcgtctttgtcgctttccatgcggcatacgagcccatatccttcatataatagactttcaacttcaccggtaggtcccccaacgccggtataaaagcatttacttccgagccaatcttgatatctttcaacagatcctcacgaatactgaaagttacccatacatcatttaaatcagagatattcatgatcggagcgcctgtaccaaccaactcaccgacttccgggaaccgttctgaaacctccccgtcaatcggagccaccaaagcgctctcgcccacatacgactccacttcggcgatagcaccttccgcacgttggaccatagcggcagcggcagccttatcttccttacgggcaccttcttttgccatctcatattgagaacgggcagccttctctgtcgctaccatagcgttataattagcctccacctcgtctcttttttgagcggacatcacccctttctcgtataaattctgaatacgatcgaaagatttcttagcgatagttaatccagcttgcgccttttgccacatctcataagcggccgtgatttcctgttcacgggctcctttaatcgctttagcgttctgcgcctccgctgccgcacgagccgcctccgcttgtttcagcttcgccataacctcgggcgtatctaaaaagaccaaagtatctccggcttttacctgatcgccttcgccaaaacgataagaagcgatacgtccgggaaccttaccggagatacgaacttgggtggcctcggcctgccccattataatatcgtcaggcggtgtaagcaggaagaaacctgccaaggctaccaatccgatcacgaccaataccgtgataaaagctaacatcatgttactgatagaaaacttcttgttctcattcatctctgtgtatatttttatttgttattactcttattcatttgcggacagtttacccaaagccttgcttagataaacttctgttaatttcacctcgatttgagcatcaatcaaactagagcgagcagaaacccatgctgtctgcgcctccattaagttcaaagccgggataaccccttcctcaaaaccgaaattcgcacgccgcaaattctcttccgcattttccatattacgggaagaagcgatcaactttttgcccgcttcattcactttataaacggattgatttacctgcaactcgatcttttcacgagcatcctgccattccagtgtttttatgcgcgtttccgctttcgccgagttacgcctataagtgccttcccaccaaccggacaagggtacctttaccataactccgacattaaacataccggcgaaatcatttttaaaaccattaaaaacattcggattcgtgacgaagtaattcgccgctaaagcgacattaggcaacatctctgccaaagcaatacgttcttttcgcttatagattttcgttgccagatccaaacttctcagttcattacgattcatgaaagcctcattcagatcggccgaggcttgtgttgtctctaccggaaaattatccagcttctcgtctgcaagcgataaatcctcctctaaagacagaccacaaatttgcgctaaaagcattcgggttaaagccagaccattctcaaccttagtctgagccatctccgcctcattcagtttcaccttgacagaaagaccatcggcctcggtagcgactccctcatagatcatagcggtcacatcactatccatcttacggagcaaatccacataagcgtccgccaatttcttcttattcaccaaagatatgacctgccaataggtctcgtcagtcttataaatcaagtcctgcaactgtaaattattcattgactccgctaattgcttggcaaacttagtgatttggttataattaacgatcttcccgcccatgaatacaggctgcaccaacgatacattacccacccagatattctgcacatccaaatgttgcatatcgttcaccccactcatcaaatgttggatcatcggtaattgggccaagccacctaaagaagagctcaaggatgaggacaaagcgcccatgtccagtaagtttatatccttctggttccacatataggcaccgtttgccgataattgaggaaaatacttggtaaaagcggctttcttctcgttatccgccatcttgatcttttcgccagagatttgtagctccttattgttctggatcgccagattccggcactcttccaatgtcaacattcgctgagcgtgcatacagctcaccgtgactacaaatgttaatagtaagatagttcgtttcatctttatatcgttttaacctacctatataatgccatcatattccctatgtgacaaaaatataaaaacccgcacaaaagtataggtttaaagcgaatataaaattgaactaattcaataaaggatacgtttcttcaacttacaataccaagaatcactaacccccatatattgagctatatatttatcaggtacccggcttacgatccattggtggttcgtataaagatatttcaggaattcttccgccttacaggtttgacggacagcgaacattgaatagagcttggaaataatcatcagcatcacattctgataacaggtagcgaaagctggatatcccaacgtcaaacgttcgatatccgtccgggagaaacaaagtaattcaccatcctcgatagctttcacttcaaactcggaagggacttgtgtaaaataaccgattgtagaaacaaaagggtacatactgtccgaggagaaaccggttacgcattcattcccattctcattaatatattgattgataaaaagccctttattaataaaataggcatcttggcacaactcgcccgtacgaatcaaataatcccctttccggattgtcacacctcgagtacaactttccaaatcccttaggaaagattcatctcgagacagaatctccggaataaaacttaggaacttctcaaagtcaggagataatttcatagttaatcatccaaggtaaatctcttctgtccgatcaaattaccgtcagagaaaatatccacacggtaagtacccggagataagaattcctcgatattccaatacatggtcacagccacctcctcaccttcatattctatcattttcttcatagaataattgatttcctttccttcaaaagcgaatacatccgcacggcttttcaccaatatatcgtcatccggtttcatgatccgtacatataccatcttttcgccgacaggagcggtaatgttcttcgctatcttgaaagtcacgacaaattgctgcatcttcttaatacgcttagcgagtttacctcgagagttcacaggagtcacgttaatatccgtcgcatccaaacgactagctaacgttactctttccgtcaatttctctttttcctttttcaaggtagcagcttgtgaagtagccctctgatatttctgaacagcctctttcttctcaaccttcaattgctcattctcacgattcaaagaatcgatttggacaacatagttacgcatgattttacgtaaggtatccaattcctttttcaagcgagctatttccttcgcattcgtagccttcaccgtacgcaattcttccaataaacgttgtacctttgcttgctccgtagataatagggcaacaagggaatcattgcctacgctaaacttataaccttcatattgaagagacaattcattatattcatcctccaaagattctttctcaagatcaaaggtttccaccaaatcagtcatttgctgcttttgatgataaatataataaccggcaccagcaataatcagtaccaatactataactgctacaataagtagcgaaagtttatttacttctttattctctttcttttcagtatccatatgaggttcttagctattacaaaagcacaaaattacaatttcttatccatccgaacaacaaagtacacctaaaaatagaaaaagacagagaggatatataacaaaaaaaggagccaatctttcgactgactccttcacctaagacggcggctacctactcttccactgttacgcagtaccatcggcgtacgtgtttttggaaaaagtcgtacatgtttttcggaaaacacgtacatgttttttcaagctgacaatcattcaccgaaaaggccgtttcgcttatttattttcatttttttaattaaaatgtaacagatcgttttccagtattttataattttgcgattgtttttaatttggctgaaagttgctcaatcctttgtagaaaccttttaagctagccacaaatatagaatatggagaatatagagacaggacttttgttaatggtagttggaatgaccaccgtatttgctatccttttgatcgttatcaatctgggaaaaggacttatcgtcttggtgaataaatacgcaccggaagagatcatagcgaagaaaccagtagcggcagccgttcgggaacaaacggccactccaacgcaaaccaccgcaatcggcagtctttccggacaggagacagccgccatcgtatcggcaatcagcgccgttacccgtggacaggggaaagttatcaaaattgagaaagtataaataatacatattaatatcatgaaaagagaaatcaaattcagtttggtcttcagagacatgtggcaatctgccggaaagtatgtcccgaccgtagaccaactaaccagagtcgctccggcaattatcgagatgggctgtttcgcccgggtggaaacgaatggcggaggatttgaacaagtcaacttattattcggcgagaatcctaataaagcggtccgtgaatggacaaaacctttccatgcggcaggtatccagacgcatatgttggaccgtgcgttgaacggccttcgcatgagcccggtacccgacgatgtacgtcagctattttataaggtaaagaaagcgcagggaacggatatcgcccgcacgttctgcggtttgaacgacgtacggaatatcgccccatctattaaatacgcgaaagaggccggtatgatctcacaatgctccttgtgtatcacgcattctccggtacatacggttgagtattataccaagatggcattcgagttgatcgagctcggagcggatgagatttgtatcaaggatatggccggtatcggacgtccgtacacattaggccgtatcgtagccaatatcaaggaaaaatatccggagatcccgatccaatatcatagccatgccggtcccggctttaacgtagcttccatcatggaggtttgtaacgcgggttgcgactatatcgacgtaggtatggagccgctttcttggggtacaggacatgcggacttgctgaccgtacaggcgatgttgaaggacgccggttataaggtgcccgagatcaatatggaggcttatatgaaggttcgtgccttggttcaagaattcatggatgatttcttgggattgtatatcagcccgaagaaccggttgatgaattccttgctaatcggaccgggacttccgggcggtatgatgggtagcttgatggcagaccttgagaagaacctagagacgatcaacaagagcaatataaagaacaacaaaccgctgatgtctcaagaccagttgttgatcaagttgttcgacgaggtagcttacgtatggccacgtgtcggttatcctccattggtaactccattcagccaatacgtgaagaacctagctttgatgaacgtcatgcagatggagaaggggaaagcccgctggagcatgatcgccgacgatatttgggatatgatcctcggaaaggccggacgtcttccgggcccgttggctcccgagatcgtcgagaaggcgaaggccgaaggccgccagttcttcgagggcaatcctcaagacaattatccggacgcattggataagtatcgaaagttgatgaacgagaagcaatgggaagttggcgaggatgaggaagaactcttcgaatacgccatgcaccccgctcaatacgaggcatatcgctccggaaaggccaaggtcgagtttaaggcagacgtggcaaaacgtaaggcagagaaagcgaacgccggtaaaccgacggtacccgccactccggccgcatcggctccggcaccagccgctacattagcgatgccaacgactccgcaagtcatgaccgtagatgtaaacgggcaagcttaccgtgtgaccgtcgcttttggtgataccaacagcgcaactccggaagttaaaccgacagcggctcccgccccgacagccccggagacaacaaatgctcccgcaggcgctggaaaagaggtgctttctccgctggaaggtaaattcttccttgtaaagaacgcttccgacacaccggtgaaggtgggcgacgtagtgaaagaaggtgatgtcctttgctacgtggaggccatgaaaacatacaatgccgtacgtgccgagttcgggggaacgatcacggcgatctgcctgtcttccggtgatgccgtatctgaggatgatgtattaatgacgattcaataatgaacgagatatttcaaaacttatatgagatgactgcgttcagcaatatcattgctgaaccgcagttcttgatcatgtatgccatagcgttcgtattgctctacctcggtatcaagaaacaatacgagccgctattgctcgtgcctatcgcgttcggcgtattgctcgccaatttccccggaggcgatatgggagtgattcaagcggatgagaatggattgattaatgtacacggcgtgatgagaaacatctgggaaatgccgctgcatgatatcgcacacgagcttggcttgatgaacttcatctattatatgttgatcaagacgggcttcttgccgccgattatcttcatgggtgtcggtgcgttgaccgacttcggcccgatgctccgcaaccttcgcctatccattttcggcgccgcggcccaattgggaatcttcacggtgcttttggtagcgatcttgatgggattcacaccgaaagaggcagcgtctttaggtattatcggtggcgccgatggcccgacggctatcttcacgaccattaaattggctccgcatttgctaggcccgatcgctatcgccgcttattcttacatggctttggtaccggttatcatcccgttggtcgttaagctactgtgttctaagaaagaattacggatcaacatgaaggaacaagagaagaaatacccttctaacatggagatcaagaatttgcgtgtattgaagattatcttcccgatcgtggtaactaccgtagtcgccttgtttgttcccagctccgttcctttgatcggtatgttgatgttcggtaatcttgtaaaagagatcggaaccaatacgttccgtctgttcgatgccgcttccaacagcatcatgaacgcagccacgatcttcctcggattatccgtcggggcgaccatgaccacggaagcgttcttgaacctgacaacaatcggcatcgtaatcggcggtttcttggcattcgccttgtctatcgccggaggtatcttcttcgttaagattttcaatttgttcactaagaagaaaatcaatccgcttatcggagccacgggtttaagtgctgtacccatggcctctcgtgtggcgaatgagatcgcgttgcaatatgatccgaagaaccatgtcttgcaatattgcatggctagtaatatctcgggagtgatcggctcggcggtagctgccggcgtattgatttccttcttgggataaatgagattaaatagtataagtagacggtgtagagacggggcatgccccgtctctacaaccggaatcaggagaaatcggccaaccttaacatctattagtatccaaaatgactttttagataaataatttccccgaaatgctgtaatccaaaaatatttagtttaatttgtgacttgatataggaatgtatttatccttttcttaaaagcgattgtatatgaaggacactcttgagactaatttgccggaagaagccgggaaattggaagaaactaaaaaaccggttgagacgccggaaatcgatgctaccgcagacgttgaagccaacgatacagcggaggcggacgctgctattgccgcaggtaaattaaccaaagaagaaattctcgctaagttaaccgaacttgttgagacttccgtagagacttcccgtggagaagtagaggctttgaaacaggcttactacaagatccgtcgtaacgaggtggaagagcttaagaaagtattcatcgctgatggtggcgaagaaaaggattttacagcccccgctgacgaaaccgagaacaagatcaaggatttgctcacctcttataaagagaaaagagccgctatcctcgccgaggaagagcgtgtaaaggccgctaactacgctttgaaattgcagttgatcgaccagttgaaagagctttgcgaaagccaagatgatttcaataaattatacaactctttcaaggacatccaacaaagatggaaagaggtgaaggccgttccccaagagcacgtgaacgagctttggaagaactatcagatctacaccgagaaattctatgatattatcaagataaacaatcagttccgtgattacgacttcaagaagaatctggaattgaagaccgccttgtgcgaaaccgtagagaaactaggtaacgagccggatgttatctccgctttccaccagcttcagaagctgcaccagcaatggcgtgagatcgggccggtagcgaaagagttacgtgaggacttatgggctcgcttcaaagctgcctcaaccgtgatcaataagcgtcaccaagagcacttcgagaaactgaaagcgaaagagcaggagaatctggatgcgaagaccatgatttgcgaacaaatcgaggcgattgatttcagcgcgttgaaatcgtttaaggattgggaagaaaagaataaggaggtaatcggcttgcaagagaaatggaagacgattggttttgctccgaaaaaatataacgtaaagatattcgaacgtttccgtgccgcttgcgatgtctacttcgagaagaagagcgagttctacaaggcgatcaagagcgatatggagaaaaacctcgacgctaaacgtgcgttatgcgagaaagccgaggctttgaaggatagtacggactggaaggatacgacggataagatgatcgctttgcagaaagaatggaagacgatcggaccggtagcccgtaagcattccgacgctgtctggaaacgttttatctcggcttgtgattatttcttcgagcaaaagaataagaacgttgtttcccaaaagagcatagagcagaccaacttggccgctaagaaagagttgatcgctaagattaagggcatggacgagagccttggacatgatgaggctatcacgaccttgaagtcttatatggcggaatggaacacgatcggtttcgtaccgttcaaggagaaagataagatctacaaggaatatcacgaggcggttgaccaacaattcgatcgcttgaaggtagaccagaacgatcgcaagatgcagtcgttccgcaacaacctaaacgagatgaccagcggcgaaagaggtaaaggccgtttgttcagcgagcgtgataagttgatgcgtatgtacgagcgcatgaagaacgagcttcagacttacgagaacaacatcggcttcctaagcatttcctccaagggcggcggcggtttactgaaagaaatggaacgcaagatcgaaaaactgaaagaggatatggctttaacagtcaagaagatcgatgccatcgatgagaatctggaataacaatctcataaacccgagcaaagccgtcctttaaaaagacggctttgttgtttttacgcttttatgtcacggatacattatttcaatcccggccacgagacggccgtacttttagggacacagaactacacggcaccgacaaacgtccgtaaaatgcaaaaagacttggcactgctgccggtttggtatgcggaagaggatgattttgtctatctggaagatagtaaggcaacccctccgtttttcgcccatttgcccaaagacctacacccggctcctatacctgtaacaaaagcgatgctgatgaaaaacgctccctacctctctcctatggacgcagccccgtggggactttccccgcatagtcttcatttattcgagcagttgagggacaaggcaaaagtccggctatccgtcccgacttggaaagaggattattttcgccttaccggtaggcaaacggcggcggaatgtctggaaaagatacaggccctcctacccgatctccctattccggtagcgcctcgtttctgcacgaaaatccgggaggtggagagatacatgatcttatgcaacgctcccttcgtattaaaaacaccctattcctcttccggacggggattgctatgggtagagaaacgaaaaccggatacaaaaacgaaaaactggatagagggcgcattcaacaaacaaggaatgatcagtatcgaaagcggattagacaaagtacaggatttcgccatggaattttattccgacgggcaaggtactgtccgttacgagggattatccgttttcaataccgaggagcgaggctcctatacaggcaacatcctagaggaacaatccaccatgctctctcgcatcacccgattcacgggcgaagagacctattcccgcatccaagaggcggtacgctctgtattacaagaagtgtacggatctacttacgcgggctatataggtgtggatatgctggtctatagacaaaaggatggatcttttgctattcatccctgcattgagatcaatatgcggtacacgatgggaatggtcgctttacgtctattccagcattatgtagcgcctagggctgttggcgattaccgggtttcttacgagaaggaagccggagaagctctcgagaaacaccgcctcatgtctgagacttatccacttcgccttgcgaatggaaggattcaagaaggctacctctcattatgccccgtcacgaaagacacacattatcgagcctatttattgctcatgtaacagattattcattacatttgtaaaaatctttagacctcagtaataccattaataaatttatcattatgaaaagattatcaatcttggccgtattcatgctgatcagcgtgatcacgttcgcccaacaagccctttggggtagtcagaacatcatctctccggagattcatccggataacaccgtaaccttccggttcatggcacccaaagcgatcaaggtgcaggtaacaggagatttccttcccacacagaagatggagactcagttcggtttagtggatgtacccggtaccgttgatttaaaggaaggtaaagaaggcgtttgggaatataccacaccggaacctcttccctccgaattatatagctattcctttattgtcgatggattaaagactacagatcctaataatgtctatctgaaccgtgacgtggcatccgttacgaatatctttatcattaagggtggacagggtgatttatacagcgttaatgatgttcctcacggaacggtcgcccgccgttggtatgagagcccgacattgggaaagactcgccgtattaccgtttatacgccggctggctatgagacaagtggcaaaaaatatccggtattctacctcttacatggcatgggtggcgacgaggaagcttggatcgccttaggacgtacggcccagatcatggataacctaatcgcccaaggcaaggctaaaccgatgatcgtggttatgacaaacggaaatgcggatcaagaggccgctccgggagaatccagcctaggtttagttaagccgaatatgcaactacctaaaaccatggagggtagcatggaaagcagcttcccggatgtcattaagtttatcgagagcaattaccgtgtggaaaaaaagaaatccagccgtgcgatagccggactttccatgggcggtttccattctttgcatatatctaagcaatatccggatatgttcgattacgtgggattattctctgccgctatcctcccccgtgaaggctccgaatctcccatctaccagaatatggatgagaagctgaaagtacaattcggcaagcacccgaaattatactggatcgctatcggtaaaaccgacttcctatacaaaaacaacgtagactatcgtaagaaactagacgataacggctacaaatacgaatactacgagagcgacggcggccatatctggaagaactggcgcatctacctcacaaaattcgccccaatgttattcaaataacaaaatacccagttgtagagacgcagcatgtgctgcgtctctatagctttataacctatatccgagtaaaatcccaaccgtgaaggttcgatcatgggcaatgaagtctttattaggctttataaaactcggaagataactgacgtttagtcccaacaaataacgatcgaaattataattaacgccggtctcacattttaatccgacaataatccggttcacggcaggagctgtctgctcgggaaacaaagaatccatatcgcctaaagaaatatgacgcttcacatttacatcaacacgaggtccgacgcctgcgtagaaattccaaccactatccgaaagagtctttactcgaaaagtagtattcaaggtgatataatcaaacatgtatttcatattcctcttcagcatattgagtcccggatctgtagcctcatagaaatcaaaacttccacctttacgtaagtaacccacattacttgacaatgcataccaaccctgatccaaataatccaatcctatagacatttgatacgatgacaaagacttatcaaaaaggtcctcaccttcattcaccaaagaagagaaagccataccattctctattttcagaacctgcgccttcatcgttataggcaaacacaaaataagacaaaccaaccatgcacaacttttgatcttcataacttaccgtatttagtttactacaaaaacgcctgaagaacgaaattcgtataaatacaataaattggcaattacaacgtattcttaaggatacgcttaaatacaatatctctgagattacgggcgatcgggatttgataggattcgatacgtaatctattcccttctaccagatcgacacgatccgcattaattatatacgatttatgcgtttggagaaattgatcatcgggtagggattccccgatccgcttcaaggttgaatgggtcaatactctaccggaagtagtatagatactaacataattttccaacgcctctacaaataagatatctcttaggtaaatcttacgcatttgcttctcgcttttcacgaaaaacgaggcatccgcatccggcgtattctcccgagccaacaggtcgtgcaccttattcacgccttttaagaaacgctcaaaggaaataggcttcagcaaataatccacgacatccagctcataccctttcaaggcatattgctcataagcggaagtaacgatcactttgggaggctggtttaaggtcgccaataaatccaaaccggaaagataaggcatctcgatatctaacaaaagtaaatccggctgctgagttttcaacagggtatttaattggatagcgtcctcacatacaccggtcaaggagagaaaatccactcgctccacatacgattgcaatcctttacgggccatcggctcatcatctgttatcacgcaggttattgtcatatttcttctatttcaatcattaattccgctacgaactcagtctcttctttccgggtttccaaacggtgcttattgggatacaataaagataatcggcggcgtaaatttaccagaccgatgcctttacgttgccgttcatccaccgatttacgcaacgcttcgtcctccgctgaaagctcggggatggagtttcgtataaacaaactgatccggttattttcccatttcatgataatatccaattgataatcgccacctacgtatttaaaagcgttctctaccaacgggaggaagagtaacggataaatattcagttcattcaattcgggcggaaactctacacgcaaccgcaggcgttcactcatacgaagcttacgtaaagctatataagttttcaaataatcaatttcttgtaggatactgaccttctgattaccgccatacagttggtaacgcaagagttcggatatcatctctaacgtgcgacgaggcgccttgttactttcatcaatctggaaataaacggtattgagcgcattaaacaagaagtgaggatgatattgggatttcaagaacttcaattccgtctgtaattgatcattcttgatcttttccagttggatacgctgctcggcgtaatctttatccaatacttgagctcgctgaacattatagaccataaacgcaaacaagctccctatcacgttcgcgattattatatcgtccatatggaaagtatcaccgataaatatacgggttattgccaacgtagcattcacacccaatataataaataagaaaggcattccatacgatctccaaacaaatttccacctattcggttctttcgctcttcggctcttctcgatctggcttccaaagtaaataaaaaacaaataagagacaaagattagaatcacgatctctaggatactattccccaaggactgtgtccagtagtgtccttctttcgtataatccgttacccagcggatacaagaatacaaagagaccgcaaaaatcaaggcatatatccacttatatatctttttcataaaccatttgtctagaggtttcacaaatttattcttttactttcatctacgctatgcttccggcgagattctttcacctccaaaccacgatttatacgataggtcaaagaaataccgactaccgtccggttcatccgctcttttataaaagcgtgctgggtaggagtcatcacgctcattctcgatacattcgaatggaaaatatcccgtgcgaataactggatcgttccccgacctttccatatcttcttctggataccggcatttatttgccataacggatagatcgcagcttgtcccgccgccattttcccattatagaaaccgataagttcagcgctccaagtccgggcaaagctaaactgattcgagatcccgatattcggtgtccatctcttattcacctttacttgataattctccggtaaacgataccggttatagatcaaggatgcgctgacgttcacgttccaaaatgaggttagcggtaattgggaggtactgagccggggacctacgctgacgcgggaagagagattttccggtgagacataaacgacatagttcccttgatccaaatagctcttgataattacatccttcgtataattgaaagcaagccccacccggaataaatcgccatgtatataggccagttccagattatcggataattccgggcgtaataaggtgttacctttatcatacgtatactcatcgtggatatatacaaacggattcaggtcccggtaattcggacggacaatccgtttgccataagtaagcgacagactattcccattcctcaaggcatactgaacagaaagcgttgggaacaagtgcgtataatgattggtaaacgaggagtctctttgataagcgttacccgattgttcgccctctatgcgggtattttccagacgaagacctgcctccagacttatagaagagaatttggcgtcaagctgtacatagcctgcgtttatattctcgtcatactgaaaatcacaactcaagtcatggtccggttgccaagaatcaccttgtaaccgattataatcagcgttattatcaatagagacaaaagaggtcttggcgcctgcatggaacgtgaaggatttcgagaaaggccacaccagattcgcttgtccggagtataaatggattcctccatccatatccccaaacaaggtatcttggctattcaaatattggtcttcctcgtatcgataacgcaagtagtccatagaggcatccaagaccccgccatcggagttaaaggtatgtgttaaacttaaaacagccgtaaaattatcctgcgaacgattctggtcgttcaaggtacgaagcaaacctccggtttgcggagatcgcttaggaatggatgagttcatgtctccctcaaccttgctacccgccagatttccatccgtggaaagccctatcgtagtcttttccgacatttgataatcgatcccgaaacgataatagtttgacttattcttccaagttcgataggaagattgcgtcatctgcccggtctccccttccggccgccaaccttccagatagcttctctccacatacaaatcatcgtaatcattcttccgggaataggaataagagagatagaagttgaacttattcgtccgcagattcaaggtagtagaagcgaaaccttccccatatttaccttggtcataactaccatttaccgaaaggttcattccccttcgcaatatcttcttcgtacgtatatcgataataccggagtttccactagcgtcgtaacgtgccgatggctgcgtaatcaaatcgattttatccgtaatggaggcaggagtcgattttaagaggttgacaagatcttgccccgataaataggtcggcttaccatccatcaagatattcgccccgttttgaccattcaggaaaatcgtaccatcgttttgtatcacgactcccggcaaactggtcaacacgtcgtagacattcccttggctttgggtgatagaggcatccagcctataagtcatcttccccggtttcatctctaccgtagggagcttagccatgatcaccacttcctgtaacttctggtccgctatcgtatcgacctgtccccaaccacaaaaaggggtaattatcaatagaactattataaaaagattcctgctcatgtcgtttttatatcaaaattacatcagcaggaatatccaatcaaattattgtgaccaacggaagtatccgggggatgaaaggtaagaaaaccttttatatagtcggtttatccacccgtccggcaaataagatagcgcccgtactcttctcctttaggacatagccgaagggatggtcaaaacgaagttcggaaatagtaggggcaggagaatccatagatagattcatatcagccatagtcacggcagccgcctctgttccggactcgtttacctcaataaaggttttctgttttacctcatttacatatacagaggcatcacacatcatcgagaaatcagccaaaaccggatcaaatgcgtctgaaatccccatcactcgcatgatctctttcaaatccatcgaaggagactcaaacttgaaccgcggaagatatagtttcagattctgccgtttcatcttatcaatccaatgattccactccgtatcatccagcccttcgataaggcgactcaacgcaacttcatcgtctgcgctaggcatgaatacgacaaggctaaacgcaccattgccataaggtaactccacgacagaaaccttatcgtctacatagcaatcagtagtattctcctgccgcatggtgggtacttttatctcctccccactattcaaataaaaaggttcgtctttcgtatccttttccttaaactccgaagtccatacccccttaaaataaatagcgttaatcaaaagagagacggcatcggaagaagaatcatcaaggatcttttgtattaaattattcgtcttatcggcacaccaacggtttactttatccttcgtcccatcattaaacggctcattgtaaacctctgcgttataatacatcttattggtcttaacaaaagattccaacaccttaaagtcgttcctaacccacacgctattggcattggtaaaaatcgtacgtccatccaatttaggcagctccgtttgcatcatttgcgcataggcgtttatctcttcgtaggtaaagttctcatagcccaaagtctcttggatctccttataggtatttccatccgcgccattcaggaccatgcccaaacaaaggttcacactcaaaggagatatacaaaagtcagccttttgcctacgagccatctctctataaaaatcgaaagagaatttttgtactttcgcatttacctcggcggatttagaggtcaagggaatgtcatatcgttccgtatcctgaccgaaattatctccctccaaatcattttcgcagcttgtcaatgcaaataacgggatgcacaggcataagaataggtagtaagtgcttttcataatacaatgatttaaatgttcctatatataatatagatgcgcaagatacacataatgttgcattttatctatcttatttaaagacattagattgttttcactcgccgttttatacttaaataaatttaatgtacgcacgtacattaataccgtatcaaaatatctccatcaacaaacaagcaatgcttccagtatgaaatctcctacttttgccttctgaaatgaataacttgcggcttgtcgagtgaataactaacgagtatacccagtgaataactaacggctttagaagtgattagttattcacttctaaacgccttttctagctgttgatcaagcaaaattctcatttccataaagtcatccacaaagaggcttttctgtctttttgagtagtattagagcttttccataacatctcatttccacaggaatcacaagataaaggaggggagataacaataaacagtgcttttccaatgaaaaagaccgttttcgatacacattaggcgacaaaagcctacacatacggtcgcgttaagcaacgccagtagtgccattgggcattataagcagtcgcaaatagggttgtaagtagtcgtgaatgggcattcttacctccttatagccctatcgtaacaccgtttttccctccttttgctccatcggatatgaattacgatgaattattttcgctagaacaaaaggctatttttcggcattgctctatcaatgaaccgattgctgatttattttttcaaattcaagcacaagacgtaccttagcccggaaaaaccgattctccgggacttccgattacaaattgtcaatcctaacagattgtcatatccttcgatcgtctttctcgaaatctctcaaagatgattatcaattcaataaaaaaacgtatttttgtcacatacaatctataaacaacccaagatatggaagtgacagtcaagaaagtagaaattaccttaccggaggtagacatggccttgctcaaagaactggccaagaaattcggttggaatatcggcaggaagaagtccggtattgagaaggggctggaggatatcaaggccggaagggtttataaggccaaagatatggaagatctaaaaaagcatttgctaaatcaataaaccatgtacgacgtacagactaccaagcaatttgataagagtttcaagaaatgcttgaaaaggaattgcaatccagaactcatatggcaagttatcggcattcttcaagaaaccagttccctcccaatgcaatatcacccccataaactaagcggtaaatttgagggcttataggaatgccatattaaaagcgactggctcttaatatggcaacaaaacgataccgaactggtcttgatcatgaccgataccggtacacacgctgatttattttaagacttgggatgatccactcggcctgcgaataaaatggcacccgtactattctcctttaagacatagccgaagggatgatcaaaacgaagttcctttaaagtggtagcgggaggaagcgcacttgtatccatatctactatcgtaacagcggcggcttccgtgccggactcatcgaccttaataaaggtattttgttttatcaagcctataaataaaggctgttcggttgatatattcgtgaagtctgcctccgacttaaaggcatccttgactcccaatgtcctcatcacatctgttaaatccatacttgattccatcgtaaagcgaggcaaatagaggtcgaacgaataagaactcaggttgctcatccactggttccaacgatccgcatccaagtccgcaatcaactcatctagcgaggttttcttcttatcggacggcataaaaagaaccagactaaacgctccgtttccataaggtagttccacgacagatacctgctcatcaccataataataatttgtcgcttgttgtttcatggtaggaactttgatctctgatccgtcctttagatggaacggcttgtcctttgtatctcccttatcgaactccattttccacactcccttgaaataaatggcgttgatcaggcatgccaatgtattgggactgattgtctccagcatcttagggatcaaatcattcgttttattggcgcaccaatggttgatcttgtccaccgtctccatattgaacggctcgttataaacctcggcattataatacgtttgattggtctttacaaatggttccagcacttggaaatcatccttgatccacatactattcgcgttcatgaaaatagtacgaccatccaacttgggaagctccgtctgcatcatttgggcataagcgtttatctcctcgttggttaagccctcataacctaaggcttcttgtagctctgtatacgtattaccattcgccccattcaataccatacccaaacaaaaggaggcgcttaaaggagagatacaaaaattcgactcctccttgccagccatttccttataaaaattaaaagcgaacttctgccctctagcgtttacctctagcgatttagtatccaaaggtatatcatatcgctcagtatcggttccgaaaggttcttcagaagaatcattgtcacacccagtcaacgcaaacaaaggtatgcagagacagagcgacaggaataggtaattgttggtcttcataacttgatatttttaatgtccttatatccaattgatgaataggtctccgtaaaagttgcatcccgcctatatatttcacgactgtgccccaacgaatggaaatgtagggatataataaaagccgtatcactgcggatcagttatacggctaaactggagtaagctatgacgggagatgatcagcggttatgcttgatcagattcataaactcctcgcgcgtcttagcttgttggaaaaagccggtgaaatcagaggtagtcgtcaaggaattttgtttctccacgccacgcatctgcatgcacatatgttgcgcctcgatcacgaccatcacgcccaacgggtccaaggtcctctggatgcaatccttgatctgcatcgtcatacgctcctgtatctggagacggcgggcgaagatatccactaccctagggatcttgcttaagcccgtaatatatttcttggggatataagccacgtgggccttgccgaagaaaggcaacatatgatgctcacaaagggagaagaaatcgatatctttcacgataaccatctgtttgtaatcctcttcctgaaacatggcggaacggagcaccgcctccgggtcctcatgatatcccttggttaaaaactgcatggctttcgccacacgttccggcgttttaagcagaccctcacgcccggcatcctcacccagcaaacccaatacttccttataatggccggccaaagcttcccgggcacgtagcgtctcttcgtttacttctgacattctctttaatttaggggaatttttatctcttctcgtacgatatacatttccttcccgtatttcgggaaagcacccatcaacaggcgcatcatatgataggcctcctcatgcgagcggaaatctcccacacgcaacttccagaacggggcgttgtaagtgacatacgtcgggatctctggaaaaagctccttgatttccttctccttacgaaaagcctcgtctttcgagacccgttggttattaccggaaaatacctgcgtacgatacccttgtaccttcaagaaggtaaggctatctgtcgtctccacgttcgctccacgcatacgctcacccaccatctcgcggatagcggcggattgattgataacgacctcgccttttcccaaaccggatctctgcaacgcatcgaatatggtcgaacgctcaccttccaacgccgtctgagcgaataaagatgaagtaccggccatcataaaggcaaatagcaataagatacaaggaattcttttcatagatagaatattaaaaagagtatctttccccattcattgaggggaaagataccttcttattatgaattaattaaaaagcctcgataatcggcatgaatttgtcaacggccaaagaagcgccaccgatcaaaccaccgtctacgttcggtttagcgaacaattccttagcgttaccggcgttacagctaccaccgtaaaggatcgtgcagttatcagctacctcattgccatatttagcggccaaagtagcgcggatgtgagcatggatctcctcagcttgctcagcggaagcagtcttacctgtaccgatagcccataccggctcgtaagccaagacgatcttgctgaaatcctcagcggaaagatcgaacaaagaaccagcgatctgagcgtctactacctcgaagtgcttaccggcttctctctcctccaaaacctcaccgatgcagaagatcggagtcaaaccgttagccaaagccaactcaaccttcgtcttcaagatctccggagtctcatgataataagcacgtctctcagagtggcctaagatcacatatttcgcgccagtagaagctaccatagcggcagaaacctcacctgtataagcacctttttccttgtcagcgcagttctcagcagcaacaccgatcttgtttgtatcgatagcggcagcaacgcttgccaagtgagtgaacggagtaccgatgatcacatcgcaattcggagtcttacccttcaaagcctcgtccaaacctttagccaaagcaagaccttcagcaagagtagtgttcattttccagtttcctgcaacaatattctttctcataacttaataatttaaatatgtaatacaaataaatctctattcagattcttttcctttccggcgacggcgattgcgcaaggcatcgtatccccaaaccagcaacaaaggtacggtaaaacttaataggttggttattagccgggcatcttctttcgctttccagtcggtatttccttccagatagccgtttacgatcgttttcagctcttcttcctgtgggatatcgttgtaatgccacttcatcaagatcgtacctttcttcagcaagaccaatcccggattggagcggatgatcgttttcaaaaggacatcatcggccataagaaacggatactcggcaccggtattatcgctccatgtagcgatagcatcagcggaagaacccgtcacgcaatagaagcccaagccgttctccaaggcgtaatcgtatacgttattaatctcgtcgatacgctcatcatccgcattctccagacggggagcgatcaaaaggaaaagacctttcgggtcgttcagcaactcatcagtcacgtctgcgtcattctcattatagatatgaaatgtggtaacggggggaacgtatccttgtttgatcagcttggtctttgaatccacgaaagtccacgtgctatcatcggccggggcgttctccaaagaaaattctttctgtacgccatccttctcgtaaataaaagaatacgcatattcatcctcgggcgcaccttccggtatcgacatcaaggcagggatattcgcacccaacttatagggacggaaatccaagatcggcaaatgattataattccggtaagcgaaaccgatagcgaagacatatgaccacaaagccacgaaccagtagacatggtaggtatagccttgtaaaagccgctgattatggatgaacacgtaaatagcggcggccaaaagtacgacattcttatagaaggtctgccaattactgatcaccaaggcatctccgaagcaaccgcaatccgatacgggattgaagatcgccagatacagcgtcagcggcgtcatgaaagacatcatcagcaaggtcaagaaggtcgtataccgccggtacacccccaatagcatacagacacccagcatgaactccagagcggacaaattaaaggagatcaagaccgtaaaaggttgcagcttatccagcccaaaggaagtcagatagtcgccaatcttaatggcgcctcccatgggatcgacagccttcaccgtcccggagaagataaagacaactcccaataacaggcggcagacctccgcgatcactttctttacggtttccttatattccatgtagctcactcctcgccaaactccagcttaatcaagccgaagagggcataattgatcatatccatgtagttagcgtccactccctcggagacgagtgtcttgcctccatgactctcgatttgcttggtccgataaatcttcatcaaaataagatccgtgtacgagctgatacgcatactgcgccacgcctcatcatagtcgtgattcttggcgtacatcagttccttcgtctcagtgatgtatttatcgtataattccaaggctttatctatcgtgatatcggtcgtatccgcgaatcccaacgccaactggatcaaaccgatcacaccataattaacgatggcgataaactccggacggattccctcgtccaccatgctcgtccccttaatctccaagctacggatacggttcgccttgataaatatttggtcggtaaccgactggggacgcataatcctccacgacggcccgtaatccttcaacttcttcccgaacaactcccggcacagggagatcacttgctcgaattgttcctttgtatttggcatactatcctagattatacccgcgaatataggaaaaaagacgtagatgttctcgaaaattcaagacaacaaaagctaataagataaatgaaaagaggttacaacgaaaaggagccactttataagcggctccttttcgttttcttacatcttatatatcgttatgaacagcgtaatgagcgtcctaagcgcaacacggtagtctttgtgataccgttcaattcgcaaagtttactaacggaagtaccgtatcttttagcgatagcgccaagcgtatcaccggatttaatacgatgataaaccggagtagcctccacatcattcattgtattcgtattttctcctaaagaagcggtagcggaagaacttgcctgtaccgtgattttcttagaagatccggaagcggtcgatttcttttgagtttgagcttttggagtcgctttagccgcggtttccacaccggcactacaacgaatggactggccgatacgtaacatagaagtagatttcaatccatttaaacgacaaagctcattcactgtcgtaccatatatacgtgcgattttacctaaggtatcaccggattttacacgatggtacaccatctgactattggaagatgtatagatattgctcttacgtccgttaatcttgacgttacgaaacacatattgatcctgatgaggtattgagttctcgaagtcaataatatcagccgggttaatagcctgtccaagaaaacgagtctcaaaatgcaaatgagatcccgtagagcgtcctgtatttccccctaaagcgatcggatctccagcccgtacgatatcgttcacacctactaagaatttagataaatgaccatatacagtctctaaaccattcggatggcgaatcacaagataatagccatatcccctacgctcgaaattcttgatacgcaccttgccgtcaaacgccgcacggatcgtatctccaatttgcactttcaagtctatccccttatgcatccgtctacggcgaggaccatactttgaagtgacccttgtcatagagtccataggcaagacaaaagtagaacaatcaatcacgcaagaatccggcatatctacctttttaccccggaaaggattcacccattcatttgtccattcgccatataattcatcggcagggaacatcaagttctctctcgcctccaactccgctttctcattaatctccgcaagctccttcaaagccatatctttcttaaagccaacacggtcggccattaactcagatacacgcttgtccataagtttgtgggttggatgattgggagtctccggagtttccggtttcaccggattctccgcatttgcagtcgataccatcacagcggcacaacaaatgaatagaaatgtctttatactcattttttgataactttcattcttataattcaggataaaacggcaatacccggcatctctgcctgattgtcaacttgtcaaagttcggaaatttgaataagccgacaaaattgattaacgaaaaatttctgcaatgactttgaataaaagcaaaacaagcgaacaaacaagttaaatatcaaaggcttacagaacaatatgtttcacaacatattagctaatcattccccaatttatcttccttgtgaacagagttttgagcctttcgctcaatatccggtgctgttcggacaataattcggggtcttcgtcaagaactccttgagcgatatcccgcgcatattgaagtatttgtccatcggccgccaagtccgctattttaaggtctatcccctcgccactttgccgggtaccttccagatctccatgtccccggagacggagatccgcctcagcgatctcaaaaccattcgtactgttcaccataatctccagtcgcttacgagtgtcattacttagtttataggaagagaccaagatacaataagattgttcagcaccacgtcctacccggccacgaagctgatgaagttgagagagaccgaaacgttcagcactctcgatcaccatgacggatgcgttcggcacgttcacgccaacctctataaccgtagtagccatcaagatttgcgcctcgccggagataaacttctgcatctcggtatccttatccgccgctttcatacggccatgtaccatacataccttatattctgggaagacctccttgaacgtctcaaaaccggcctccaagtctttataatccagtttctcatttccttcaatcaagggatataccacataaacctgacgccccttttgtatctctttccgaaggaactcataaagttgtgcctttttattatcatagcgatgaagcgtctgtatcggtttacgtcccggaggtaactcatcgatcaccgatacatccagatccccatacaaagtcatcgccaaagtacggggaatcggggtagccgtcatcaccaacacatgcggcacgatcgcattcttcgtccaaaggcgtgagcgttgctccacaccaaaacggtgctgctcatcgataatcgctaatcccaacgaagagaaaaccactgtctcctcaatcaacgcatgcgtcccgatcacgatctggatctcaccgctggcaatagccggtaatatcttatcccgctctttcttcttggtagatccggtcaaaagagcgaccttaacgtccatatctttcaggaatcccatgatcgtcgcataatgctgggttgccaatatctcggtaggagccatcatacaagcttggcaatgattatctatcgccaatagcatagacaataagcctaccaaagtcttgccactccccacatcaccttgcagcaggcgattcatctgccgcccgctacccatatcgatccggatctcacggactacccgtttctgggcgttcgtcaactcaaaaggaagatactctttatagaacgtattgaaataatggccgaccgtagggaaaacgatcccttttagcttcagtttccgaacgctagcggtacgtaatatatttaattgtatgaagaaaagctcgtcaaacttcaaacgtaactgggcgtcacgcaacttagcggcagattccgggaaatggatattccgcattgcctctgtcatagacatcatatggatccgtttcaatacgtcgggggaaagcgtctctggaagttcccagttcagccagcttaacaacgtatattgcaggttctggatcgcccgggaattcaagaaagatttcttcattttctccgaggtattatagaaaggagtcaagccattcgccacttgatcagcttgctccattgagtcgatatccggatgcggtatgttataggtatgcccaaactccgtaggctttccgaaaactatatactcggtattgggacgatacttatctgtcacataattcaaacccttgaaccagatcaaatcgatcgtgcccgtaccatccgagaacttaccgaccagccgtttactccgtccctcgcctagcgtatcgaaatagagaatctggcctttcaactggatataaggcatattcccactgatctcagctactttataaaaccggctgcgatctatatatttataaggaaaataaaagagcaagtcctcatacgacgatatccccgcttccttttgcaggatatccgccttcttgggtcctactcccggcaagtacgtaatcgatcgcttatcaaggtccagcataacatctatgagtttttagggtttaccgggcaaacatcgcttccgctattaacaaatcaaagggcgtggtaatcttgatattctcacgatcaccgggaaccgtatcaatcgcatgccccatcgcctccaccacggaagcgtcgtccgtaaataaagacgaataaggttgctcataggcttttgtcaataattccagatggaagacttgcggggtttgtacagccatatagcgggaacggtccaccggatggctcccttttccatctgtctcacgcagggaatcaatcatcggaacaaccgggataacggctcccgtgacagccgctttatcaaagcaggcctcaacaacctccggagagacgaaaggacgaacgccatcgtgcacagcgaccaaactcagaccgctatcctcctcccccttccgacgcctctccgccaaaagccaatccaatccattcttaaccgagaagaagcgagtatctccccctttcacgatcgcatgcgggaccttgcagccgatttccttgcaaagcatattccaatacggctgatgatcctccggaagcacaaggattatacgtgcggaagcatcccaacgatgaaaagcctctaacgtatgcatcaaaagaggtttcccccgcataggaataaactgcttcggcagatctccacccatacgaagccctttacccccggcaacgatcaagacgtacttatccatcaatccaattcctccaaaacttttttaacttcctcatccactttatacagcttctccttgcagagcttgatcagacgggtagcttcttttaccttctcggacaggatatcgacatccaagtctccattctcgatctcagccacgatcttacgaagtttctcgatcgcctcgttatatgtttcttctttcttcgccatattaattatgtatttatcggacggttataaaaccaccctctatggtttgataatactttttatttcaccatcgatgaagcgagtcgtcagttcttcgccggctcgcaaatcagaggcatgtttgataatcttgccatctttcaaggctaagctatagcctcgctttaagatataatcaggagaagccatcttgataaactgttccgtaagctggataaaacgcccactctcggaaagtttagaggtaataccgttccgcaagcgaagttccgtattctcaagcaccgactggcggcgtgataacaaacccgatgccatcgcaggtaaacggctcgctatcgtttgcagtcccgaacgattccgctcgatccggcttgtcacgatagaagggaaacgggtcgctaccaattgtaaatagtttttctgtcgggatagaatatccatagccaataaactcacgtcttgacgcaaactctccaactcctcaccaacgctatccattcgggaaataaggaactcggcgacagcggtcggtgtcttcatccgggtatgcgctaccaaatctacaaccgtatcatcccgttcgtgcccgatacccgtgataatcggtaaagggaattgagcgcaattcgccgccaacagataagaatcgaagctattcaagtccgaggtagccccacccccacggataatcacgaccacatcaaaaagatcttgatgttgataaatccggtctaaagccgctattacagaagcctccgtccgttctccctgcatcaaggcggggaataatttggtatagaacggataacctcctttattccgtgtcaactgattcataaaatcctcgtagccggcagccgtcggagaagtaatgatagcgattctcctaggaagtagcggaaaaggcaattccttattcagtgtaaagaccccttcctcctgcaattggcggataatctccatacgcttacgcaccatatcacctaacgtataagccggatctatatcaagcaccgtaagactcaatccatacaactcgtggaactcaacagacaccttcaccaacactttcaagccggaagcgaacatctgaccggtctccatctcgaaataaggtttcaacatacgaaacgtcttcgcccagatagaccctcgtaccttggccaccaattgcccggtctgcacattcttctccacaaactccagataacaatgtccggaagaagtattcacccgcacatcgctcatctccgcacgcacccagcaagtctccgggaaagccctcgacaacgcaccccgtatacgagtattcagctctaacaaagatagagcctctttctcacccgataagttatttagattcggccgcatatttacgctcttgtttataagctttgtacacatccgggatgccatatcccaactcagcgtccggttgctcaaacttactgccgaaacgctgcaaaagagagattatatccttattcgtcagactgggaaacgcttgccatagacaaacacccaaccccgctaagatcggcgtagcgaaagaggtaccgttcgcgtaacggatattccccgtaggatctatcacgcaacagcccgtacccaaggcaaccacatccggcttcacccggtaatccgccgtaaagccaacagaactgaaattacttttcttcttacgatccgtgatagcgcccactgtcaatatatccggggcatccgctggaaaggttatctttccccagctaccgcccccctcgttgccggcgctactaaacaacaagatcccttttgatgaagccatcttagcggcacgactgatcaaggaagtcctcccgtccaattgatcttgatgatagttcagggcctctacatcaaaagagaaataccccaacgaagaagagaccacatccactcccacgctatcggcaaattccatagctgccgtccaataatcctcctcgatgggaaactccgaacggctatcctcgctctttatcagccaatattcggcttggggagccgtaccgaccatcaagcccggcgcatcagcggccaagcaagataagaccttcgtcccatgatcatccccgatgaaaacgcttcggccggggaaaaccacgttatgcgttcctaataaccgcaaggaatcaaatacgctgatccgatccacgttcatgaaaccggcatcgaccacggccacacgcatacccttacccttaaagcccgcctcatgcaatttgataccgttcagcatcttgatctgctcctcggcataaccgtaaggcgatttctccggtttatctattggcataaaccgtgtcgtatcattctcctccctaggaatatcgatttcctcgtcacctttccagacccatttcacggaatccacgatcgggaggcgcaagagacgctcagcgaccaagctatccggactggacaccacgaccgtagagaaccatttactctccagcaccggttttcctccattggcggacaaggtatccagataagcttgagcgatcggcaaatccgattccgacaccgatataccttgccggctccgtcgctcgacagactccttggaaagatattcctccgggttatccagcgtataaccggaatcccctttatctttcaaatacacccgaaaacgaaaactttcccccgcatgtactcccaaagaaaacaaactgaatacgaaaacgaatattcctatatatttactcatagaacctcacaaaccaaaaaacccggcactggaataggccgggctcatgtataattcttcgtcttattcattgatattacagatagggatctcacgtttaacactttggcgtaaagaaatcaaggtctctgtagccgtaacacccggtatctcttgaatcttggagttcaaaagttccatcaagtgctcgttatcacgggcatacagcttgatcagcatcgtatacggacccgtagtgaaatggcattctaccacttcgggtattttctcgaattccgggacaacatccttgtacatagatccacgctccaatttcacgccgatataggtacatgtattataccccaatattttaggattgatgtgataccctgagccaacgatcacattcatatcaatcatgcgttgaacccgttgatgaatagctgcacgagatacaccgcactcctcggcaacatctttaaaaggaatcctagcattctttgaaataatgttcaatatctgccggtccagtttgtctatcttctccattttaaattcgctttattatatgcattcagatttaatgtatcaaaagtatataataaatttgaatcatatatcattctgaaagaaaaaagtaatcaataaataataaaagcgggcaaaaaatgctttttagcataatttgcccgcctattatcttacaaacgttccgtttctatttcttcgctacttattcttttacgatgtcaagcaactcaacctcgaacttcaatacgctgttcggtttgatatcttgtcctgcgccacgttcgccataagccaactcagccgggatccagaagatatatttagaaccgaccggcatgatctgcaagccctcagtccagcccttgattacttggccaacaccgaactcagccggctcgccacgatccacggagctatcaaacttagtaccgtccaatagagttccggtataatgaacttttaccttatcggtagcggtcggcttcgcgcctgtaccttctttctctaccttatattgcaagccgctctcagtcgtgataacgccttcttttgtcttattctccgccaagaacttatcgccctcttcttttgtcttcttagcctcgcgagcctgagcctctacgaagtaagtctgcaaatattgttgagcctgttgcggattcatcttcatcgcagaagaatcccctttgatagcttggataaaaccagcgatcaaatcatctacgttagcctcaccacccggcaaagtctttaagttttccttataaccggcacctgtgctgataccaatagcgtagcttgcgctatcgatagaagtcttcaagctcgcgcttttgtgagaatcaccgcaagaggtgaaagatgcgcccattgctacaatcactgtagcgactaatacacttaactttttcatttttctttaactcttatatattatttttcgatatctaataactcaacgtcgaagatcaacgtactattcggctcgatagcctcacctgccccacgctcgccataagcaaggttagacgggataaacaatctccatttagaaccgaccggcatcaactgcaaggcctctacccatcccgggattacctgtgaaacaccgaatacggcgggctcgcctctctgtacggagctatcaaacacctgaccgttgattaacgtaccgtgatagtggcattttaccttatcgttcgccgtaggtttagcgcctgtaccattcttcagcacctcgtattgcaaaccgctaggcaactctaccacaccagccttatgcttattgatagaaaggaactcctcaccggctttcttattgatctccagtttctcttgttgaagcttcatgaagtaatcattgatcacctgttttgcctcatcataactaagagcaggttttgcctctgttaagacgtcattcaatccctgtacaaaatcttccacttgaagatccttgatgcctgagttctggaaattatttccgatacttaagccaagcgcataacttactttatccattcttttttcttgttcaactaattataagccacaaaagtaatgcttttaatcgtataacagcattttgtaagaactttttatttcattcaaagctttttacgaaataaagtcgtaacttcgtaatattatatatacatctatacattaaacaagtaacagatgaaaaagttagtcatacttaccggagcgggaatgagcgcggaaagcggcatctccactttccgtgactcggacgggttatgggagaaataccgggtggaagatgtcgccacgccggaaggcttcgccgccaaccctaaattggttctcgacttctacaaccagcgcagaagagagttattgaatacgaaacctaacgctggtcacctcggccttgccgccttggagaaagatttcgacgtacggatcattacccagaatatcgataacttacatgaacgcgcgggtagcagccacgtgatccatctgcatggagagttgatgaaggcatgctccgtaagggatctggacacgacctacgatctatcaccggagaatccggatattcatctgggtgacaaggaccctcacggaaatcagctacgtcctttcgtcgtatggtttggagaagcggtacccatgatagagccttccatcaagctggtggaagattgtgatatcttcgtgattatcggcacctccttaaacgtctatcctgccgccggtttgctgaactacgtgcgtcggggccagccgatctatttgatcgacccgaaagatgtacgtacttatcgcgacgatatcgagcatatacaggccggggcctcggaaggggtcaagaggctgacggagttacttacgcggaattaaacaattcatacactcattaggtctgacgaaggcaagtataaacacgaagtccttggcatgcgaacacattgccaaggacttgtctttttatccgcttccatcctcacggaagtacttacggatgaactttaatttattactttagtattaaggcgatagccgatggagaggagtcagtccgtaaggggtgactcctttttctgtttttatttattcgattctgattggataaataaaataagatgtatatattcgctccctataacttaataatgtgttgtatggttaagaagtggatattccctttattgattggggtttgtttaatcaatacgtctatggcacaagaaaatccgattttattattcccaaaaggggcgccgggagaaactattaaattaatagagaaagctgatacggatggtggaaaaaccggtggtgagagtgttttgcgtattacgaatgtgagtgagccaacgattactatatatcatgctccggatgaagtggcctcgggtgccgctatgattgtctgtcccggtggtggttacaatattttagcttatgatttggaaggtgatgaagtctgtgaatggcttaataatcttggaataactgcggtcttacttaaataccgggttccaagacgggaaggactggaaaaacacgaagctcctttgcaagatgtacagcgtgcgattggttatgttcgagcgaacgctgagaacttgaatatagatccaaagcgaatcggtgtgatgggattctcggctggtggccatttagctgccatggttagcaataattttttgaaacgtacttatccggctattgatgctacggataaagtaaattgtcgtccggactattgtttattggtttatcctgcttatttagatggagagaatttccaattggcaccagagttaaaggtttcatctgccacacctccaaccatgttaattcaagcggaagatgataaatcttatatcaacagtagtattttctattattatgccttaaaggaagctggtgttccggcatggatgcatttatatagtcaaggtggccatggatatgggttacgagatacgggagcgtctgtaaatgaatggccggatcgggctgaagattggtttcgtgagatcggtctgatcgaatagaactccagatatcttttctggagacttgcggagtagattcttaaatcgattgcgcaatttatttattactagtttattattgatggtaaacgtagtaaaagcgtagtctgggaaagcgtgttctatagcatatcgtatctttgaagtagtgagtttattgctgttttctgttattcgggctttttttgaagtaaaaaagctaagttatgaaattccttaaaagttcagttttatttatttcaatggcatgtatagtgcctgtttgttcgatagcgagagaaaaaagtgagagaatcacaagagctgagattgaacagaaaagtgcggatgaatttataaatggtctgatgagtcgaatgaccgttgatgagaaaatcggccaattgaatcttcctagttatggaaacgtaatgccaaatcctaaaaagagtgagatagccagtcgtattgtacgaggagaggttggtggtatatttaatatattcggtgtcgatgcgatccggcagttacaagaagtcgcagttaaagaaagtcggttggggattcctataattgttggcgctgatatttgtaatggttataaaaccgtttttcccattcctctaggtctttcgtgtagttggaaaccggagaatatagaagaggtcgctcgaatttccgcaaaggaagttggtgctgatggtatctgttggacatatagcccgatggtcgatatatctcatgatgctcggtggggacgagtaaaggaaggagcgggcgaggatccgtttcttggaggtataatggctcaagcatgggtgcgtggttatcaaggcaatgatttatcggctgatacgactcttatggcatgtgtaaagcattatgcgctttatggagcggccgaggctggtcgggattataatacggtggatatgagccgtgtgactgccatgaattattacatgcgtccttatcaggctgctgtagaagcaggagtaggaagtatcatgacttcattcaacgaatttgaaagtatccctgcgaccggaaatacttggcttcttaatgacgtgttgcgtaaacaatggggatttaacggctttgtcgtgtctgattttacggcaatagcggagatggtaaaccatggaataggtaatagtcaggaagtcggagtcaaggcgctaaaggcgggtgtcgatatggatatgatagcggactgttatcatgccgtattaaagaaatcattggaagatgggaaaataacagaggctgagattgactctgcttgccggagaatactaatcgcaaaataccaattgggattgttccatgatccatataaatattgtaatccgaaaagagccgccaaagagttcttgtcggtaaataatgtatcagcggcccgtcgtattgcggcggagtctttcgtgttacttaaaaatgataataatctgcttccacttaaaggatgtcgtaaggtcgctgtagtcggtcctttagcggatagcaaggcgaatatggctggatcgtggaaatatgatgagcagactaaatcttatcatggattggtagaggatttacaggaatctttgggaaatggagtagaggttgtttttgcaaaaggcagcaatctagtcgatgatcccgtttatgaagcgaactttacggatcaaaatcgttcaacccgggatgatagaagcgatgaacaattaatcgccgaggccctaaaagtggtggaaggcgctgatgtgattatcgctgctttgggtgaatcgatagatatgagtggagaaggcgctagtagagccatccttgaaatgccgcaaacacagaaaaaattactggatgctatccagaagacaggaaagccgatcgtaatggtactttttaccggaagacctttggcattacaatccgaggaaaagcaggtgaatgcgatcttgaacgtatggttcggtggtacggaagcaggagcggctattgccgatgtcttgaccggaaaggtttctccgacagggaagttaaccatgtcttttcctcgtgtaacaggccaatgtccgatctattataatcataagatgacaggacgccctatgtctcccgatgcttggtacactcgttatgtctccaattatatagatgtgttgaatgagcctctttatccatttggttacggcttgagctatacgacttatacgtatggcgatgtatctttgaatatgaattcaatggatgcaaatggaaaaattcaagtatccgtgattgttaccaataccggggctcaggatggagaggaaatcgtacagctttatttacgtgatatcgtacgcagcataacccctccggtccaagaattgaaaggattcaagcgagttgcgttaaaagcgggagaaagcaagaaagtaacctttgatattgatgtggatatgttgaaattctacgattcaaccttagattatgtcgctgagccgggtgagtttcaggtaatgatcggtggaaatagtaaagaggtgaaaacagcttcgtttacattaaaataatcctaatcggaaggaatcagttatgggtctttgctaaattcgaaattatatgtatctttgccaaaagaaatattacaaaaccatggggatgaccggttttgacagcgggtagaagtggtttgtaagcatgtagtgcgtggttggcttgcacttaaatctcagacaacgaacaattaactggcgaaaataattacgctctcgctgcttaatcgaagtatagtagattcaagcttaatccctgcaaaagttgcggggacgtgacatcacccggatgctgtggctccgaagcgttccgatcaggtggtgcagcaatatcggagatagtttgagataagcctcgggtctcaggcgaaactttagaggataagggatgagtgggtggcttcggtcttgctcttccccgacaatgaaggcgaagataaacatgtagaaagcaaattaattcctcgtttggacgagagttcgaatctctccatctccacggaatgaaaaaaggtcttacggattgtccgtaaggccttttttcattcattgtaaacccctttataaggaggtggcggtacgtatggaccagccttttgatggggtaatatatcaaccgatttgacgattacgttattacctttctgggtacaaaccagacattttgaacgtaatttccttttagccatgttgaagacgatattcggattgaaatgaactccgtttatacgagtctcaaaatgtaaatgctcggtagtagccctgccagtacgtccggttaaggcgatcggttgtccggcgagaacacgatctccgggtttaaccaagttcttggagttgtggctatagatcgtttccagtccattataatggcgaacaacgataacgttgccataggcggcgaatggtttcgccatcctgacaataccatcgaaagcagacacgatcgtatcgttggcacaagttttgatatctactccggaatgatgtcttctccttcccccgtaaggagagatcacgtttccattaggaaggggaaatgcgtattccccggcggggatcaaggataaatcaataatttccgtgttattctcatcgaatagcttggggtccttgatcgctatctggcttttatcacggggcgtaaaggcttccgtgatatcttttctaggagaatgacaaaccgctagctccggagcttccggcaacatgaaattgaaatccacgacgggaagaggaatatttgccgtagggaaatccacagtttcgggaggggccgggcgtggagcaggcttttgcgtacggcaagacgcaaataaaattagcgtaagaatgagtattccattgtgtattttagatgccattagatattgttttaccacaaaagtataaaaaagcctctttcaatgacctatatttccgatatgtttatacttctttttattctttgtgttttttctgatagttgaatttgcctacctttgtaaaggtaaaatggagatattatacgatgattgaggggactagtttgtctctttggtcagagaggatgacgatattgtatttgctggtatttctctaaactgaaaacgaccaatttaaagtacacagagaaatagacaatgcgaatacacctgtatttggtgtgttcctttgccttatttctgttgtgtacaaggcatttggtcgtgccgcagtttgacgggtttaaggtaaagtgtaacacaccttttctcagatgtgggtttatttatgagataagattaccttaaaaacggcttttgtatatgaaagaacaaaaggagatacatatcggttcgttaataaaagagaaaatggaagagcggggactttcggtttccgattttgcccatgcgttgcattatgaacgtaccaatatttataagatatttaagcgaagcagtattgatgttgatttgttactgcgtatatcggaagtcttagcctatgatttcttgcgggaggtgtatttagtggacgaaccccggcgatattcaatcactatagaagcggacaaggaagatatagaggagatccgtaaatggctgttagagaaaaggcgtgaataagtttcacgctttcgtgaaataagatcacggtcgatataagaccggtcactttgattgtttctacatttgaccgtctcgatgtttcatcataacattagagaaataggttaaatcaaggccgtgctcttcttgttccgtatgtgaatataggcaggaagaaagcggccacttttttcttctgtgtacgtgcacaattcgattatttcctttatatttgtcgataaacaacgaattgttaacatttctaatatgaaagttctaaagaccgccctgctattcctgatgtgcgtatctttctccttctcctgtaaggaaggggtaaaggaagtaagggtgctgaaactggcgcacggattgccccccagccattccgtccatttaggattgctctatatgaacgagcgtctgaaagagttgtccggaggaaagatgagcatggatatttattcttccgctcaattggggtccgaaaatcaatgtatagagttgcttcaaataggaagtctcgatatcacgaaagtttcctccgccgcgttggaaggatttgccgatccgtttaaggtatttggcataccttatctattccgttcccgtgagcagtttttcgaggtgttggatggttcggtaggtaaacagatattgggatcaacggaaccttattggtttaggggactcgcttattttgactcgggggcccgtagcttttatacggtaaacaagcagattcgtactcccgaggatctgaaaggactgaagatccgtgtgcaaaagagcccgatagccgtggagatgatgaagacattcggtggttcggctactcccgtggattggggtgaattgtatacggccttacaaagtaatgtcgtggatggggccgagaataatacgccttccgtgacaacagcgttccatcatgaggtggtaaaatactattcagtcaatgagcacacgatgtgtccggacgtgatcatcattagcttggctacttggcagaagctgacggaacaagaacgtaattggctgcgacaggccgctgacgccgccgctatttatcaacggaaactttgggcggagcaagagaagcaatcgctagaggagatggaagcgcatggcgtagagattatttacccggataagcagccgtttatggatgccgccgccccgatgatcgagcggtttaagaatgatccggtttttcatgatttaattgatcaaatacagaatacccatgagaaagataattgataaaggattggagctatcgttgattttcttgatggctttcttggtcgtggatgtgctatggcaggtattaagccggtatattctggtttccccgagttccgtgacggatgaattggccggatatttattgatctgggtgggattgttgggggccgcttatgtatccggtaaaaatgagcatctagcgatcgatttattgcttcaacatatgcgtccttcccgcagaaagctcttgcgattgtttatcttcttgatcgtatttttattcgctgtatttgtattgatcgtaggaggggcttggctggtatacactcgttttcatttgggagttacttcggcttccttagagattaatttaggatatgtgtatttggcattgccgctagggggattgcttaccgcttattatgcgatagataacgcgatcgccttatttcgttcctctaattcttaaaagactgatgatatggatattataggtatacttgtattagtgataagtttctttttcctgctggtggtcggggttccggtagcgtatagcatcggtgtggcgggtatattgacgatgctcgtgaatatagactcgcttcccgcccttacgacttatgcgatgcgtatggcttcgggtctggacagtttcgctctgttggcgatcccgttttttatattggcggggaatatcatgaatagcggaggtatcgccttgcgcttgatcgatttcgctaaagtgctggtcggacggttgcccggaggactggcggtagtcaatgtcgtggcgaatatgttattcggggcgatcagtggctctgccgccgccgctgcctctgctatcgggagtattatgacaccggagatgaaaaaggccggttacgatccgaatttcagtgccgccgtaaatatctcttccgccactaccggcatgacgatacctccgagtaatgtcttgatcgtttactccttggcgagtggtggagtctctgtatccgccttgtttatggctggttatctaccgggaattcttacgggagtggcgatcatgatcgtagccgctatgtttgccgcacgaaaggggtatccggttggcgtacgtgttccgttctcggaggcgacaagggtatttttcagggcgatccctagtttgatgctattggtgatcgtgatcggaggaatcttggcgggactgtttacggcgaccgaggcttcggcgatcgctgtattgtatgcgttaatcctctcttttatctataaagaacttacttgggctaaattgccgcaagtgttattgcgatcggccaagactacggctatcgtccttcttttggtggcgacctgtacgggtttgtcttggatcatgagttatgagaatattcctcagacggtaagtgccgctttgctaagtataagcgacaatccggtggtcatcttgatacttatcaacgtgatcctattgattgtcgggatctttatggacatgacgcccgctgtcttgatctttaccccgatcttcctgccgatagcgacggggcaattggggatggacccggtacatttcgggatcatgatggtattgaacctttgtgtgggattatgtacgccaccggtgggttcggtattgtttatcggatgtagcgtggcggggacaaagatcgatcaggtgatccgtccgttgctgccgatgttcgcagcgatggttatcgtcttgttcttggtggccttcttgccggatttaagcttattgattccccggttgttcggtttgtgatgttcccccatagggtcgaagtagccttgtgctataaatagggcagtactgtgtacgaagtatcccagtacttacgtactgagtaccgcaatacttcgtacagagtactgtagtactttagccacagtactgcggtacttcgtacacagtactgtgctaactgtaagacgctgtctttttaatgtcctttgaacagggataaggcgatacccatctccaatccccgtagttcggccagaccccgtaaacgtccgatgcaggagtagcccgggttggttttcttctttaggtcgtctatcatttgatgtccatgatccggtcgcatggcgatggagcattggcggcgttgttgcaattccagtaaggctttcatgacaccgtacatatccacatcgccctccagatggttcgcctcgaagaaattaccctcggaatctcgttgcgtactgcggaaatgaacgaaatcgatccgatccccgtaacgttccatgatcccggccaagtcgttatcacttctgacaccgaaagaacctgtgcataggcaaagcccgttgcttggattcggcacggcctctattaacttccggaaatcatcttccgtgctcaagatgcggggaagcccgagaatggaataggggggatcatccggatggataacgagcttgacaccggcctcgtccgctacgggagcgatttcccgcaagaaatagatcaggttcgagcgaagtctctccgcgtcgatatctttataacggtctaacgcttccctaaactgctcgatcgtaaaagtctcttccgagccgggtagtccggcgatcatattgcgaaccaatagctggcggtcttcctcgctcatagcgtcatagcgtgccttggctttcgccttgtccgcctccgtatattcggcttccgccgccggtcgtttcaatataaataagtcgaacgccataaaagccgcacgttcaaagcgcaaggctttggaaccatccggcatcgtataagccaaatcggtacgagtccagtccaataccggcatgaagttgtaagtaactacccggatatcgcaagctcccagattacggatgctttgtttgtagttctctatataggtttgaaaatccccggtttgcgtcttgatatgctcgtgtacgggcacactctcaactacactccaccgtaatccggcggattcgatcaaggctttccgcttttgaatctcttccgtagtccaaacttccccgttcgggatatggtgcaacgcatttacgataccggtggcacccgcctgacggatgtcccaaaggctgacaggatcattcggtccgtaccaacgccaagtttgctcacatagatacataatgaataatttttaaatttatcaatgtgccaatatgccaatgcggtttgatgcatggctggttggcacattggcacattatttagatggagaaagcgtcgaagcctccgtctatggggatcacggtaccggttacgaatgcggaggcgtcgctcgccagccattgtaaagtaccgagtaattcctccggttttcctaagcggcggaacggcgtgtgcgcgacgatcgtgttgcaacgatcactaggtgatccatccggattgctcatcaatgcccggttctgctcggtaaggaagaatcccggtgccatggcgtttactcgcaggccctctccgaatttaatcgctagctccccggccatgtattgcgtgaaattgttgatagcggctttcgcgcatccatagccaaccacacgagtcaatgggcgtagggacgattcggacgagatgttaataatgcttcctttcccttgccccaccatgacctcggcgaagaccattgtcggcagtacggtcccgaataagttcaggtccacgaccgtccggaaagcatcgatatccagatcaaagatcgtcttgtcgggaggaatcgtcgctccggcttggttaccacccgccaaattgactaaaacatcaatcttcccatatgctttcaatatctcttgcttgttttgctccagcaaggctttatccagtacgtttgaaaccaagaataaggcctcgcccccttccgctttaatctcaccaaccaaggcagatcctttttgctcgtttcgtccgaggattacgacgtacgcgccttctctcgccaagtgcttggccatgcaggctcctaatataccatagcctccggtcaacaaaatcactttctcttttacgctaaataaggagttcatcagatataattattgtagtattgtatattttcctttaccaagatatcaatcggcatataattgacaggctcaattttctccttaaggatcaaatgcctaaaaagtgccttgatacaatgatatccttgtacctccggtcgctgggcgatcaaatgcgtgatcaagccgttttccagataacggacattcggttctatcacatcgtagccaagaagcttgaaaggatagtccggccgttcgctacttagataatctccaaggaaatgggccctcgaattaaagatgataccgattcttacttgaggatatttgtcgaagaaagtattcagtagtctcgtattctcttctcggtcatccgcgtgcacatgcagcaaatgaatctttcccttgaatgaggtattggcgagataatcccggaatccttcctctcgcttctgcacttgcgtagaacatgaatcccccttacgggtgaaacggaaaatcactagatcgtcctcttcacggatttgctcgaataaaaggcgtcccgctatataccccgaatcatatgaatgcgttccgtagtaagagatacaattcgtgtggtcgataaaagaatcgattaatatataaggaatacctttctggtctagccgctgggtcaaggtcaagacactttgcttgaataatgtagcaatgataaccccttggcaatccgcggtctcaatcttcgggattaattcgtcgaaactgttgctatcgtattggtcaaaatagatttgctcgacgtctatattatagctaaacaattcccgttccgctttctctatcccttggcttagtttcgcccagtattccccttcaagaaaagaagggatcaaagcgatgaaatgatattttttcttcaacgctaaagaacgggctatcagatttggttgatagtcaatttcttttaagactttctccacctttttccgtgcatcctccgatacctttccccgctcatgtaaaatgcggtctaccgtaccggttgatacgccggataattcggcgatatcttttatcctgtaatttttattcatggtatagattgtagtgtgtattcgtcctctctgcttattcgagtatttgaagaggagtgttcaatttacggaaaacgtagccatacatcatatagataagaggaacggcgacgaaaattccgataccgaacaaaatacatcctaatatcaggatcccgatcataaccaacgccagaatgaacagaggcaatacttgtcctttcgttatctcccagcttttatgcaaagactcgataatcccggcgttttcctcgataataaaggcttggaagaactgaaggcgcaatgccagataaataccggggatgataaaaaataagaaacccgccaatacgacaaatcccgtgataagactcgctagaaagtaggtgatgatattctttgtctgttgtccatatgcggaaaactgaggttcttccccatccaacgcctgaaatatatttttcatatatcctaaggagaaaataatggagaataacgcgctgatcacgtttacgatgattttaccgataatagaactttgcatgggcatcgcgaacgctgtcagcgtgaaagacaagatacaatatccgattaataatccggctaatatccatagctgcgacttcgttcccttccatgcggtactgaatacttctgatattataaatttaggctccataatatataatatttgtttattgtgtgtggacacaaatgtaaaatatattgttgaaaaaaacaattttattttcgtttgaaaccaaaagaggtgtatttcaacgggtacttctttctaagtgctattaatttaggtgaaaaagataagtaggaaacagaaatcgtgtaaaaagtttctacatttgtaggatgaaacagcgagtaaagaccctattgtgtgaatagatgtaaaagatatccacttgggttagaaagagaaggtaactgaaaaacagccttgaatatataattatatacaaatatggataaacgaatgctgaaaattacgattactcagttaaggcagatcgcattgtttgcggttggtatgtctttattaactgcctgtggaaacagtcagagtggtatgaaattaggggatgctgagttcgctgtgatggcggtcaattcaacgactagcgaccaaacaacatcctatccggctaccatcaaaggtacgcaggatatcgaagtccgtcctcaagtttctggatttatcgtgaaattatgtgtggatgagggagctacggttcgtaaaggacaggcgttgttccaaattgatcctacgcagtacgctgctgcggtaggtcaggctaaggccgcggtagagatggcgaaggcaaacgtaagcactttaacattgaccgagaagaataagaaaactttgtttgatcagaaaatcatcagtgatttcgagtatcagactgccgtgaaccagctgatgtcggcaaaagcgagcttggcgcaggcggaggctcaattggttagcgctaaccagaacttgtctttctgtacggttacaagtccctcgaacggtgttgtcggtacattcccgtatcgtgtaggtagcttggtaagcgcttcgatcgctcaaccgctgactaccgtatctgagatcggtgatatgtatgtgtatttctctatgacggaaaaggagctattggcattgacgaaagccggtggtaccttgaaagagcaattagagaagatgccggccgtaagactgcaattggcggatggctctacgtaccatcatgagggtaagattgatgccgtgagcggtgttatcgatcaatctaccggttctgtaagcatgcgtgctattttctctaacgagggaaatgtcttacgaagcggtggtactggtaatatcatcttcccatatacgatgaacgatatcattacgatccctcaatcggctaccgtggagattcaggataagaaattcgtatttgtattgcagcctgataataccgtgaagaataccgagatcaaggtttccaatttgaatgatggcaaaaattatttagtgacgggaggcttgaagtccggtgataagattgtcgtggaaggcgtacagatcttgaaagacggccaggaaatccagccgattactcgtgagcagcaaaaggcaaagtacgatcaggccttgaaagaccagcatgacggtaatttgcagactgcttttaattaataggtatatagaataagacaaatattcgcttttgtcgagtaaaaacgaaagatatgaaattagatagatttataaaccgcccggtgctctccacggtgatttccatcttgattgtcatcttgggtttcctaggcttgatttccttgccggttacccaatatccggatatcgcccctccaaccgtttcggtaagggcaacttatacgggtgccaatgcgcaaacggtattgaatagtgtgatcgcgcctttggaagaccagatcaatggtgttgagaacatgatgtatatgagttccaatgcctctaataatggttccgcggatatctccatttattttaagcaaggaacggacccggatatggcggctgtcaatgtgcagaaccgtgtatctatggcacaaggtttgttgcccgccgaggtaacgcagattggtgtgacgacccagaaacgtcagaactcaatgttgttggttttctccgtatacgcggaagatgatcgttatgactcagagtttcttgagaattacgcgaagattaacttgatcccggaagtccagcgtgtgccgggtgtcggtgatgccaacgtgttgggtacggactactccatgcgtatttggttgaagccggatgtgatggcccaatataaattaagtccgagcgacgtaaccgttgccttgtctgaacagaacgtagaggccgctccgggttcgttcggcgaacaaggaaatcagtctttccaatatacgatccgctataaaggacgtttgcaagaggctaatgagtttgagcagattgttgtaaaggctttgccggatggtgaggtcttgcgtttgaaagatatcgccgatatcgagttggggcgtttgacttacaactttatcaaccgtgtaaatggtcacgacgccgttacctgtatcgtttaccagatgccgggaaccaacgctacggaaacaattagtaacattgaaaccttgctggaggaaactcagttgacaatgcctcccggaatgaaggtgaatatttccatgaatgccaatgacttcttgttcgcttctatccatgaggtaatcaagactttgttggaggcgttcgtattggtgtttatcgtggtatatgtgttcttgcaggatttgcgttctacgttgattccggctatcgctatcccggttgccttgatcggtaccttctttatgttatccttgatcggatttagtatcaacttgttgactctttgtgctatggtgcttgccatcgctattgtggtcgatgatgcgatcgtcgtcgtcgagggtgtccatgccaagttggaccaagggtacaagtcggcgaaactcgcttctatcgatgccatgagtgagttgggtggcgctatcgtctccattacgttggtcatgatgtccgtgtttattcccgtaagtttcatgggaggtacggccggtacgttctatcgccagttcggtctgacgatggcgatcgctatcggtttgtccgctttgaacgccttgacattgagtcccgccttgtgtgcgatattcctgaaaccacacgatacggaacataaggaaaagaaaacgaccttcgtttcccgattccatacttcgtttaatgcggcttatgattctttgttggctaaatacaagaaaagtatcgtattcttcattcagaaaaaatggctttcattcggtattgttgccgcatgtattgcgttattggtgttcttgatgcaggttactcctacaggcatggtgccgaacgaggacacgggtacgattatgggtgctgttacgttacccccgggaacttcccaggagcgtacctttgaggtaatgaataaggtggatagcttgatcgctgccgatccggccgttgagtctcgtacggcggttgtcggttttagtttcatcggtggtcagggaccttcttacggttcattcatcatcaagctgaaagattgggaggagcgttctatgatgcaaaattccgatatcgtatatggtagcttgttcatgcgtgcccaaaagatcgtaaaggacgctcaagtattgttctttacgcctcctatgatccccggttactcagcgtccagtgatattgagctgaatatgcaggataagaccggaggtaatttggatcgtttctttgatatctccaaggaatatatggctgctttgacggcacgtccggagatcaagtccgctcaaactacgtttaacccgaacttcccgcaatacgagatcgatatcgatgccgccgcatgtaagaaggccggtatcagtccgaaggatatcctgtctaccttgcagggatattatggtggtttatatgcctctaacttcaaccgtttcggtaagatgtaccgtgtaatggtgcaagcggatcctgatttgcgtaagaatatggagtccatgaagaacatcaaggtaaagagcggtaacgatatggctccgatttcccagttcattacgatgaagaaggtatatggcccggatatcatcagccgtttcaatatgtataccgccatcaaggtcatggttgccccggcggatggttataccagtggtcaggcgttgaaagcgattgacgaggtggctaagacaacgcttccggcaggtttcgactatgagttaggtggtatggcacgtgaggaggcaagtacgagtggcagcacgacggctttgatcttcttgttgtgtttcgtattcgtttacttgctgttgagcgcgcagtatgagagttacatccttcctttgtccgtattgctctccgtgccgttcggtttgatgggtagctttttgttcgtccaaggttgggccgctttgggaaatatcccggcgttgaagatgatcgtaggaaccatgtctaacaatatctatatgcagatcgccttgatcatgttggtaggtttgttggcgaagaacgctatcttgatcgtagagttcgctttggaacgtcgtcgtatgggtatgagtatcacatgggctgccgtattaggagccgccgcccgtttgcgtccgatcttgatgacctcattggcgatggtggtcggattgttgcctatgatgttcgcgttcggagtaggagcgcacggtaaccgtacattgggtacagcggctatcggcggtatgttcatcggtatgatcttccagatctttattgttccggttttgttcgtggtattccagtacttacaggagaaattcaagccgatcgaatgggaagatttggataacagcgatatgagtacggaaatagaacagtacgctaaaataaaataagagatgacaatgaagaaacaaattatatatatggtatgtgcgactgctttgttaagcagttgccatatctataaggcatacgagcgtccggattccatcgatgcgacgggaatttatcgtgatccggtttccgagactgatacattagcctccgcggatacgaccaatatgggaaaccttccttggaaggaagtttttcgtgatccgaagttacaggcgttaattgaggagggattagctaataatgtagatatgcaggcagccgttcttcgggtagaggaagcgaaagtattgttgacttccgcccgtctgtctttcttgccttctattaatttcgctccccaagggacgattacatcgattggaaatagcgaatacgtaaaggcttactcaacgcctttggccgctagctgggaggttgacctattcggaaagctcttgaacgcgagccgtggccaaaaagcctcctacttacagagccagtattcaagacaggccgtgcgctctcaattgatcggtggtatagcgaatacttattataccttgttgatgcttgatcggcaggtggaaattaccgctaagacggttgatatctataaagagaatgttcgtgtcatggaggctatgaagatagcgggtatggctaccgaggctgccgtgacgcaaatgcgtgccgcttaccatcaggtttccggctcgttgatcgagttggagagccaggtgcgtagcgtggaaaactcattgtccgtgttattggctaaggcccctcaacagattgatcggggtactttggaggaacaagtaatgccggaggatatcatggtgggtgtacctttgcaattgttggagaatcgtccggacgtgaagatcgcggagatgacacttgctagtgcctattatacgacgaacaaagcccgtgccgctttttatccgggattgaatatcacggcgacagcaggctggacgaatggttcaggcatctctgtcgccaatccgggccaatttatgtttcaagctttggcttcgttggcccaaccgatcttcaacaatggtaagttggtcgctaacttgaaggtatcgaaggcagaagagaagatcgctcaaatgaattatcagcagacaattctggaagcaggtaaggaggtgagtgatgctttacatcagtatgatgccacgagcaagaagcttgtccaagatagagcgcagatcgagcagctagagaaagcggtggcttataccagcgccttgttccagtcggctcaatctacttatttggaaatcctttccgcacagcagagcctcttgagcgctcagttgacggaagtatccgacaatgtgcaacgtatgcaagcggttgtcagtttatacagtgccatcggtggtggtagagaataataacctttaaatgtagtaaagttatgattagtccattagcatatgtagattcaagcgcaaagatcgggaagaacgttacgattcatccttttgcgtacattgataagaacgtggagatcggggatgattgcgagatcatgcctcatgccagcttgatgagcggtacacgcatgggaaatcgcaaccgtgtatttaacggagctgttatcgctgctgagcctcaggatttcttttataagggaggtgatacgatcgccgtaatcggagatgacaacgtgattcgtgagaatgtggtgattaaccgttcctcgacagcggaaggacgtactagtatcggtaatggtaatttcttgcatgagggggtacatgtttctcatgatacgcggatcggaaatcgtagtgtattcggctatggtagtaagatttccggaaattgcatcttggaagattacgtgatcttcggaggcaatgtgttgatgagccaaggatcccgggttggggcttgggcgatgattcaaaccggctgtcgtttccgtaaggatatccctccttttatcgtagcggcaaaggagcctaccacgtattatggcgtgaactctttcatcatgtctcatgagggattctgtgaaaaggttatcaagcacatcagtcatgcgtaccggatcatcttccaaggaaacagcagccttacggatgccttgttaatgatcaaggatcaggttccgatgagtaaggagatccaacatattatagatttcgttggtgagtctaaattaggtattgtcaaataaataccaataacaaacgataggtaaaagccgaaggaaatcatttcctccggcttttttatataatggaaggacggtttggttaataatgtttgttaaataatggtaaacgtgcagcatttgtctctttttaagtgtcttactaaaagacaacacgcaatgaaatccaataaaggaggtttaatatgaaaaagtcatttttattatatcttatcatgtctgtatttctcatcggttattgcgcttgcgataatgatgaggaaaattttgatacggctactaccggacaagtgatcaaagtcccggatgatatcaaatcttttaattcagttacaaaagaaatcgttttcgagaagaatatttctatcaagcaagacgtgctaggcaatgagaaggttgaattccggatagctggaaacggtcacttcacggtaggcagtatctcttcgataagttccgttatctataatgccccagtcttattaggggattatcagagatattatttatatgatggatatcctgttgtagatgttctacaaaatgaggtaaggaaccaagaggaaagggacgaaaacatgcaaaagatagagaaagcttggagcaacttcctgaaagtattgaatgaggctggaaagttgaagtagtgattaccggtttgggatgaaacgaataaacttagtgaagctcgtattgaactagtgaaggcttttcatattcaaacaaaaactgtacttttgtcataaatgctttaccgtgatcttttgaaataaatcaatggagatacgtatgtatcttcagagattgaaaaatacgaatattatcttcgttccgtcgtaactgtccgtatccacataaaaagaaagaggccaaccccgaaggaccagcctcttttatcgctttaatagaaattcaaattaaagtgcacccacttctttcaaagcctcgttagtcttatgaacagcggcagcgctcttagcgaacaactctttctcctcagctgtcaattccaactcaacgatcttctcgataccgttcttgccaaggataacaggaacaccgatgcagagatcagattcaccgtactcaccttccaagtaaacagagcaaggaaccatcttaccttggttgtgaatgatagactcaacaacaaatgctccagcagcacccggtgcataccaagcagaagtacctaacaatttagttaatgtagcgccaccaaccattgtggaagcaacaacctcttgcaatttctctgcgcttaacaatttgctaacagggatacctttgtaagtagccaagcgagccaacggaatcattgtagtgtcaccgtgaccaccgattaccataccctcaacctcgttagcgttacagcctagagcctgagataagaaatatttgaaacgagagctatccaaagcaccacccataccgatgatacggttcttcggcaagcctaaagacttcaatgacaaataagtcattgtatccatcgggttagagataactaccaagattgcgttcggagagtatttcaagatgttttgagctacgctcttaacgataccagcgttaacaccgatcagttcttcgcgagtcatacccggtttacgaggaataccagaagtgataactacaacgtcagagttagctgtcttctcataatcgtttgtgcaacctacaaccttagtatcgaaacctagcaattgagcggtctgcatcatatccatcgctttaccttcggatacgccttcctttacgtctagcattacaacttcgtctgccacttcattgaaggcaagaacatttgcgcaagtagcgcctacatttccggcaccaacaactgttacttttgacataataaataagttttagtatgttattacttaataatacgctatgttttttaacgatggcaaaggtacaatctattacggaataaagaaatatttccgtatatatttttgagggacattattaaatatcgctaaagccttgtcgaggcttcttgacaacttggtacgcttttatttttaagatattgaggaaatgttgtatcttgggtgcgaacaaaacttaaccgagggaagttttatttacatgggttattaatcttaaatccaacgtacttatgaaagttcttatatatatccgaaaagtcctgtttttgtttctgtgcggggccttgtctttctcttacggctacggtcaggagctgccgcttctgccggatacgatcaagcctctcttgtcggactccaatttgatagatgagttgatcactgtcggatatgctacgggcaatcgcagtactttatccggttctgtaaaccgggtgaatgaagggggaatgaatgagggattgatctctacacccttggacgctcttcggggaagggtgtccggcgttagtatcccggttggaggaaatagcgccgctgccttggctgccgtccgggtccggggtacaacttccttaacgggaggtaatgatccgttggtgattattgatggggtttttgccgatcttaatttgcttagctcgatctatccggcggatatcgagaacttcacgatcttgaaagatgcctctgagactgctcaatatggttctcgtggtgcttccggtgttatcgaggtaacgactaagaaagggcggcagggagcttttagtatcagttatgatgggagtttcggtgtggaggcggcttataaaagtttggatatgttatcggcgaatggtttccggaaactggcggaggaacgtaatatcggtattttagatttagggaataatacggactttcaggatgagatcacccggttagggttggtgcagaatcatcatatcgcttttgggggtggttcggagacttccagttatcgtgcctccttgggatttgtggaaagggaaggggttatccgaaatacgaactcacgtaattttacgaccaagttgaatattacgcagcatgcgttcaatgatcttctggtctttgatttaggcatatttggttccttgctaaaaaatgcttatttaaatgatgtacagaagatgttctattccgccgctactttcaacccgacatttccgaatcataagaatatggagacgggtagctgggatcaaataaccaacgctagccagatcacgaatcctttggcttggttggaggtgaaggatgatgattcgaatgctcatataaatacgcacttaaaactggtttttaacttgagtaagcatttaatgtttacggctttcggttcgtatacctataatgtaatagataacgcccaatacctccctacttcggtttgggcgcatgggcaggcttatcggggggagcggaaaacagaatctttattaggagatttcatgttggcctataaaaaagactttggtttgcatcaactaaatgtattgggattggcggaagctcagaaaatgataacgagaggtttttatacgactgcgacgaatttcagtaccgatcgttttggttatgataatttacaggcaggtgcggtacgtttatgggaggggaccggttcttactatgaggctcctcatctggcttctttccttggacgtgtgaattatatttatgatggaaagtatatcgctaccgtgaatgcccgtgcggatgcctcttcgaaagtgggggccaataataaatggggttttttcccttcggcttctgtcgcttgggtgttgaccgaagaggagtttatggaaggtgtctcgtgggtaaggaatttaaagattcgttcgggatatggcctatccggtaatcaagatgcgatcgattcttacaattctttgcgattgatgaagcctaatggggttgtttccgtaaatggtgcacccaccgttaccttgggtacgatccgtaatgcgaatccggacttgaaatgggaggtaaaacgtacgttcaatgccggtatcgatgccgggtttttcgacaatcgttttattctcgccgtagattattataattccaagacggatgatatgttgtatttatacgatgtaagcgttccgcctttcgcttataataaaatgttggcgaatctgggatcgatgcgaaatagtggcgtggaattgggtattggcgtcacgcccttgcgtacgaaagatatggaattgaatataaacgtaaacgtaactttccaacggaataaattgctctccttgagcggttactataaaggggaatatatgtccgccccggaatataccagcatctcggatttaaatggggctggtttccatggagggtataatcatatcgtttatcaaatggtcggacagcctttgggggttttttatttaccgaaatgtacaggtttggtttccgacgggaatggcggctataagtatgagattgaggacttgaacgggaacggggtgagtttggaggatggtgaggatcgttatattgcgggacaagccatgccgaaaacacttttaggctctaatatcagtttccgatataaacaattcgatctatcagtacagattaacggagcctttgggcataagatttataatggaacatcgctaacttatatgaatatggatatattcccggattataacgtgttgcgagaagctccatccctgaatattcaagatcagacggctacggattattggttggagaaaggggattatatcaattttgattatttgacgttgggttggaacgtgcctctgggtaatttaaggaaatatgtaagaaacgtacggctttcggtttccgtaaataatttggcgacaattacaggttattcgggattgactccgatgataaatagctctatcgtaaataatacgttaggtatagacgataagcgatcttatccggtggttcgttcctatacgatggggttgagttttaatttttaaaaaggtgttcgtatgagaaagctttctattttatcctatatatttgcgggtttgatgttatcgtcgtgcgatggctatctgaaagaggaccctcgtgatcagctttatccggaggatgcgtacgatacccctcagaatgtctatctgaatacggttgcttccttatataattatatcggaggttatagcgatagccaaggattgcaaggaacgtaccggggtgtctacgacttgaatacctttacgactgacgaggccatgctcccgactcgtggcggcgactggtatgacggtggtttctggcaaggtctcttcttgcataagtggggaacgaatagtgacgctatccaagctacttgggaatatctgtataaagtaatcgtattaagcaatcaatctttagagatattaggcgagttgcggcaaaaaaaggattataacgatttagatcggtatgaggcggaggttcgtgccttgcgtgcgatgtattattattatttagtcgatatgtttggccgtgtccctcttatcgtttcttcttccattccggtgaaagacgtgcggcagagtgaccggaaagaggtctttgattttgttgtaaaagaattacaagaatcccttttgttattgagtacggcgcatagtaattcgcccggcgattattatggaaggattacgagaccggttgtttatttcttattggcgaagttggccttaaacgcagaagtgtttacggataacgactggacggatggtctgcgtccgaatggacgggaaatctattttagggtaggcgagaggaagttgaacgcttggcaaacggttgtggcgtactgtgattcaataacggacttaaactatagcttatctccgaactatgcggataatttttctgtatttaatgaatcgtccggagagaatattttcacgattccgatggataagaacttatatacgagccaaatgcaatatcttttccgctcccgtcactataatcatgccaaagcatatggattggggggagagaacggctcttgcgctacgatagaggcccttcgggtatttgcgtatgggacggactcggtcgatacccggttttatgagaattattacgccgatacgatgtttgacctcaatggtgatacgattcggttagataatgggactcctttggtatatttacctctagaggttaggttggatttgtctaggttgcctgccgagaaaacggcgggtgcccgcatgaagaaatacgagatcgataagatggggacgaaagatggaaagctatcggataatgatatcgtattattccgttatgcggatgtcttgttaatgagatcggaagcgaaagttcgtaatggagagaatggggatgaagagttgaatgccgttcgtttccgtgtgggaatgttacctcgtaaggcgacattagaaaatattttggctgagcgtcaactggaattggcttgggaaggctggaggaggcaggatttggtacgttttggaaagtttacccgcccttatacggatcgccctcaattgccccatgaatcgaatggctataccaccgttttcccaattcccgataaagtccgttccttgaatcctaatttgatacagaatccgggatattagtagatttggattgtatttatcaattatgtaataatttggaatataggaagattttatttttctttgtgtaaaaagtaaaacgtttgtctatgagatcgcaaaaagagtgtatagaattgctacgtggctattttcaaaataaggctaaagattatggcattgttcgtatggccctttttggttcagtcgtgcgaaatgaacaaacagaggagagtgacgtagatattgcttacgaaggggaagctaatctattattacgtagccgaatgaaacaagagttagagtctttgtttggatgtagagtcgatatcattcgtcttcgcaaacaacttgttgatagtgtatttggacaaaatatcgaaaatgatttgatttatgtttgataaggtacggattggctcattgttagatcgaatagaaaattcgattctcttaatacagagtaaatcgggggagataaattgtccggatgatttccttttgagtcaagatggtatgttcattttaagtggcatctgtatgcagttggtttttattggagaaagtgtcaagactattgataataaaactaatcatagttatttaataaaatatacagatataccttggactgctattatgggattaagggatattatagctcatgagtatcatcgtattgatgaggaagagatctttgcggttgtgaataaagacttaatttctcttttgaaaataattcagcaaatgaaaatggatttagagacaataaattaagggtgaaaataatattcaatttctcacccttaatatctattttactctatatacaataccaatccctttaaatattcaccttccggatggtagatattcaccggatggtctgcgggttgggttaattgatgcaagatacgaacgctacggccggattgggcggcggcgctaaatacagctaaacggaagttttccttgctgacaacctgtgagcaggagaaggtaaacaagattcctcccggcttgatcttctcgaaagcgatcgcgtttaatttgcgatacccttgtaaggcgttacgtagtacattcttatgtttagcgaacgcaggagggtccaatatgattaaatcataattacttcccattttttccaaatacttaaacgcgtcttccgcatatgcctcatgacggggatctcccgggaaattcaactcgacattctttttcgtcaaagaaatcgctttcgccgaactatctacggaatgaaccaccttagcgcctcctctcatcgcatagaaagagaaaccgcccgtataacagaacatattcaatacggagcgatcttttgcgtaatactccaacaaagagcgattctcccgttgatccacgaagaaacctgtcttttggcctttctgccagtctacacagaatttcagtccgttttctatagcgatatcttccacttcgcctccgaataagtaaccatcttcgctacctaaattcgctttataaggtaaagtcgcttccgatttatagtagatgttttgtaaagtatcgcccaataccgctttcaaagcctccgcgatctgatgacgggcataatgcattcctaccgaatgtgcttgcataaccgccgtatgcgcatacatatcgatcaccaatcccggtaagttatcgccttcgccgtgaatcaggcggaacgtattattattttctaccccagccagccgcaaggtctttctgagttcgtaagcgatacggatacgttcaacccaaaaagcatcgtcgatggcgattggggtgaaagataacacacgtacggcgatactgccgatttggtaatggccgatcgccaaaaaacgctggttcgctccgtatacctctaccaagtcaccctcttccggatcgccttcaacagattggatcgctccggaaaatacccatggatggaaacgcaatagcgattcttctttcttaggcttgagaaaaactttacaatactccatttatgcttgattcaataaattatatattcttaggcaggcccaagcatcgagggccgcatatttcttttgtgagtctgtcaatacatccgcctcccaattcgtgaggcgttgtccttttgatatctttttttggaaaagtatcgcatatatcttttgcaggctggcatcctcgatgccgaactggcctacgtaattctgtaaatcaaggaaattagcgggttctatatccgaacgcttccgtatcgccccgaaatcatcccgtaaagataacccgatctttaaggtcgaactgctttttaggaatttctccagagattccggtataccgatatgattcaagcggaacaagaaacaagtatcatccgttgatatctgcatcaatgagatcttgtaacgctgtcccttcttaaagctgggacgggtctccgtgtcaaaaccaacgatcggaaaacgcagcaagtactctacggccttgtctgcctcctctttactaaggatcgtaatgatacgtcccttgaattcctctacggtaagtttcgctatttcctctttagcaattgtatgtataaattgttgtatcattcttcctcttcattcttttccaaatcctcatcaccactgtaacgcacagcgtgcaacgctttcaaggcattcaataattgctgtccccagtattcttggaagttcgtgcggcacaaagcgatagcctcttgcataacttcctcgtttccttgacggaataaagatacgaaatttcctgtatcttgatagacatcagccaagttctcggaaataaacgctgcgataggagtatcgctataccgcatatccgcatgaaatgtttccagataggaatctcgttcgccaagcaaaccggctatccgtgaacgaaccgactcgtacatgtcttctgaaacggaaagctcgagttcggtttcctcttcagattccacttcgggcaacaggctggcctttaagtataaaagaggcaaaagttttgtcgccttatctacgaagtcgaaaagcccggtatttccggcggtctcaacaaaggtacaatattccagtgctaccgtaacaaattctagcgtgttgcgctcgtatatcggattttcttctttttccatgtgcctgttcgtctaatcattcttgataacaattcgcaaaaatacaacaaaaatccgtttttttcgtgataaagtcccgaatattctttttagtcggggattgctctcctatatatttcctgttttattatttttgtgcaattaatagaaggaatgttaatgatagactaatgttggatatactaattaggataaaaaaaccgatcgagttatgagttcatgtggaaagaatgagaaccctcaagagatgaatcgccgtaaattcttgaaggtatttgggggtggggctgtcgcctcttcggcggcgctttacggttgcgctcccaagaatgagccgggggcggctgtggcgttaggtgaggttcctaccgataaaatgacctatcgtcaacatcctacgaatggcgataaggtttctattttaggatatggttgtatgcgttggcccttgaaacaaggatcggacggtaaagaccagattgatcaagaagccgtgaatcgtttagtggattatgcgatagaacatggggtgaattactttgatacttctcctgtttatgtacaaggtatgtccgagaaagcgaccggtatcgcattggcacgccatcctaggaactcctattatttggccactaaactgtcaaacttccagaactatacgagagaaaactcgttggcgatgtatcggcagtcgttccgtgatttgcaaaccgattatctggattattatttgcttcactctatcggtggggggaatggtatcgagcttttcaatgaccgctatataaataatggaatgcttgatttcttggtgaaagaacgggaagcgggacgtatccgtaacctaggttggtcttttcatggggatgtaaaagtgtttgattatgtgttggatatgggcgtgaaatgggatttcgttcagatccagctgaattatctggactggaaacatgcctcggggcgtaacgtaaacgctgattatctgtatggcgaattagagaagcgaggtattccggcggttatcatggaaccgctattaggaggtcgcttatcgaatgttccggatcatatcgttgctcgtttgaaacagcaacggcctgagaatagcgtggcttcatgggcttttcgtttcgccggctctccggatggggtcttgacggtgttaagcggcatgacgtatatggagcatttgcaagataatatccgtacttattccccgcttattccggtaacggacgaggagaaagactttttggaagagacggcccagcttatgatgaaatatccgacaataccttgcaatgattgcaaatattgtatgccttgtccatatgcgttggatattccgggcattcttttacattataataaatgtgtgaacgaaggaaatgttccgaaaagcgtgcaagacgaaaattacgcaaaagctcgtcgtgccttcttagtcggttatgaccggagtgtcccaaagttgcgtcaagcgaaccattgtacagggtgtgagcaatgtaatcctcattgtccgcagggtatcgatatccccaaagagatgcagcgtatcgataaattcgtggaagagttgaaagtgaatggttaacctttaaacaaacggaaaattatgttacgaaaaataagaatattcgccgccaccttttgctttgtgctgataaccctgttatttcttgatttcacgggtacgattcacgcttggttcggatggttggcaaagatacagttttggcctgcgttgttggctttgaatgtcggtgttgtggtagggttggtaatcttgactcttttattggggcgtgtatattgctccgttatctgccctttaggggtattgcaagatattatttcgtggtttgctagtaaacggaagaaataccgcttttcctattctcccgcattgaagtgggtacgttatggtaccttggttgtttttatagtggcttgtattgctggtgtcggttccttggtagcgttgatttcgccttatagcgcttatgggcgtatcgcttctaatttatttgcgccaatctatcaagagggcaacaatctattggcctattttgcggaacgtatggatagttacgctttctattcggtggacgtatgggtgcgtagtctggctacgatgggaatcgctattctgagctttgtcatattggcgattttagcttggagaaatggacgtacatattgtaatacgatctgtccggtaggtacggttctcggttttttgtcgaagtatgctttacttaaacctcgtattgataccgataaatgtaatggttgcggattatgcgcacgtaaatgcaaggcttcttgcatcgactctaagaatcatgcgatcgattatagccgttgcgtgacttgtatggactgtttggataattgccgtcaaggcgcgattttgtatacgagggcacgcaaggctgataaagctacttcggtaaaagaatccttaacgaaggacactacggatgtttcccgccgtcgagccttgtcggctacggcattggtagccatgtcttccgttttgcatgctcagcagaaaaaactggaggattatgtggagatgaagaaagacggaggctttgcgccgattaaagaacgtaaagagccgaatcgtttggcaccattggttcctcccggagctttgagtatcgggaatctggcgcaacattgcacggggtgtcagctttgtgtatctgtctgcgagaatcatgtcctgcgcccgtctacggatctgatgaaactgatgcagccgaagatggcattcgatagagggtattgccgtccggaatgtgtgaaatgttcggaggtttgcccgacgggagcgatcaaacctattacgaaagaagataaatctgctatacagatcggtcatgccgtatgggtaagagatctttgtattgtcaatacggacggtatgagttgtggtaattgtgaacgccattgcccgacaaaatcgatccagatggtggcgaaagatccggcagatccaaagtcgttaaagatcccggtgatcaatacggaaacttgtattggttgtggtgcttgcgagcatctttgtccgtctcgtcctcaaagtgcgatctatgtagagggtcacgagatgcatcgtatgatttgataaatactgagtggccgaaggggagacggcagccttttttattagcggtatagccatcgttcgtaagtgctagtgcttatgggcgatggctatactgctttggggctacgtgagtataggcgtggccttgtgacaatagtcgtgtcatttatatgcagtccggaaggcctgttctgccagtctttctccgattacctttttgtttcttggatgtacatcgtatggatctccaatgtctagggaatataccattcccgtatttgctaatgagatttgctgtttcttcctgaaagtttgttgaacggattcgtctccaaacatttccggacctggaatcaaggagatttgcacatataagaatggcatttctttctttctccatttgttgcgccaatctgtaatcagagacttgaacatatccgcatataggtctggtttccaaacatcattttccccttgataccaaatgatgccttttatattgtgattcaagcacggatggatcataccattgaacaaagcgcctagattgttttgatactccggctgaggctggggaatatggtctgctatggttagctcccatttccctgttaactcagttttatatgcggtatctctggtggagatgaaaaagcagcttttatctccttttacggagggtgcttcaaaaggttgcgccaagcggatgagcagttcgtttttccctgggcaaatgcaggatcttggaacacgggtgatggccggttccggatacatgaattctccgatctctttgccgttgaaaaaaaggatactttgcctatttaatactcctaacgacaaggttaatgactcttttgcgtatgtttccggaatatcgatctctttccttaaccaaatgacattaggtagggaggatcgcatattgttcaattcgatcgtttcccatgcggaatgaggtaattcgtggatttcttgaacttgtccatccctgggaatagatatctggcattttctttgttgattagacataaaggctttcatcactttgtctcgatctggaatagtggaaggccttatatcattcaaggaatccttgaattgattcaaaacctccttgctttcccaagtcagaatagaagtacccgtccatgagcaattgatgatacctatcggtattctcaatcgtttgtgtaattcttttgcgaagaaccaagcggtagaggaaaacgtgcggatcgtttgaggattggctatctcccatctcttttctggtacatcttcaatttctacggcagcgggatatttcggtacggagaatagccggatatctggataatcggaatctgatatctcctctttataccgatagatgcttgaatggggcaaccatttccagccctccatcggatgttccatattggattgtccggaagccagccatatatcgccaactaatacattctcgaaggataatacctcacgtgcggtctgtatggtgagaacgtaaggtcctccggctttcgccgcaggtaattcgagcttccatgttccgttagcgtctgtgtggcatgatactatggattcatgaaatgttacacgaatggcctcttggggaagggctgttccctgtatgacaatcggttcttctcgttgaataaccatattgtcagcgaacaaacctaatactcgaagtctgccgaaagcggcagaccccgaatatatcatgaaaattatgaaaaggaacaaggttctgtttaccatactgcgattaattcacctgttatatccgtaaattcgtaataagttccagaaaaatctgaacctttttttaattccagtgaaggtttgttatagggataaccaatattgttgacaaccttgaaattggcatcatccactcccgggtagattcggacggtcgcttgttttaatccgttaattcctattctacgttttactttccactcaactggtgctacttcataacaggatataattcctttttcctgttttacaaaaacacgacattcctcttggtatgatttgggcatccgataatgtgcgataccgtttcttagctctgtttcatatccggtaaagatcggtgcgccttgtggaaacagccattgttgctctatggtctggtttggtgtaaatccggagaaatagaaggcgttgtcatttctggagatgcagttgattggattcttcatgtcggcctccagtttgtcaaagtaaacgctatatcccatattgttcagagaatatcttaacaaggatgagccgttaaaccattgtttcggattatcgggagttaagagatgtcctcctcgataagtggccgaattggttccccgtaagtagacaaccataccaccattccaatccttctcttgtctcaggatagcgatatcccttttctgggctcccatgaaggcttgggctaagactttagttgatggatcgctagtgttgtttactagcgtttcgatacctcctccagacatatcttcgttatgtctgagaatcgaggaaccgggtgtcttgataaggtctgaacgcaactgcgtctgtactctcatctcccctgaaataggttctacctgtttgatatttaggaaatcaaggaacttttggctcgcatgcgaggaggggccataaacgaataatttccctcccttcttgacaaactgtatgagctgcttttctaaatcggatcctgcgtcgggtacgattgagactaggatagattcatcaaaggtttttttgcccgctttcattaattctacgaaattcccggtagagacaacggtgttcaaaggaaatccgtcattgatggcttgttggataaaccaatctccataataaatttcttttactcgctccggttgcttatgggcccaatcatgatattcgtcaaaaggatagacccaaacaatcaaacccggctggtctggcgctgtcctgcggccttgtagcagatggggtatcatctcggatggaacttgctccggcatgttaccatacgagtcatcaatagtcagcaacgtgaaatgagtaggcaatttgaccttcccctctctgtctatacgggcgacagccataggtaaatagatgtcgtgagcctctcttccgtaacgatcgagccaagggctgtttgcccaccagggatcatgtatatagtatctgaacaaataacgatcgtctggtaattctgagatacgagacatatagccagccaattccagtccaaaattaccatctaacgcagcccaaggtgagttaggcggtggcaacagattgaaattgccattatagatcgcctttaaatcaacgccatcttttgctaagtcggctccgacagagatatttgtaccacgtgtttcgattcggatatctggacattccgctctgaatttgttccaaaagtcagtaatcttctctcgggtatcgttcaacttttccggatggaactgtttaccatcgaatacagctccagtggatccccacgtttccattccaaatccaagtccgttggagaaccaaaggaagtcgaatcccatatctgttaagaaatgctggctttgttttccgaagaacgtaccgaaaggagtaccttgcggaataccggaaggatagccggcataatgttctttatcttcattgagggttgcgtaacaacaaacgaacgttttagctcccattgtattacccatacagatctccggatgtttcttgtatttgaattcggatttagcgaattcaggacccgggtcaaatgtctccccaatccggacaacttttccagtcaatcgctctccatgtctttttaaagcggatacgatatatttcaagtctccatacgtgtattgaggaggattcgggatataatcataagcgcgttgatgtaggcttaattctttgggccctgaattaacttcatggtctgtattcggatttcctacatattgagaccattctaaacgctggttgtcatctccggtataatttaatatctcggatccatctgcggtccacagcataacagagattgtatctgcgtgtcttaacagtggagcccattggatgaaaacatttctacaaacttgatcaatggaatcccgattattcactttgaaaggctttaacgacatctccaagtggatgtcgttaaaagattggattcgtttgtcgagatcatatttatccttgaatagatcactttcagagctattcctgctacaagagggaagcaggaatagaagtgatgcgaatgctaagattgtcttgttcatattgttttttatataagattgaaatgtagaaaatagattaatatccgggattctgtgttaaattgggatcaatatctctttgattctgtggtatgggtaataatagcccatattctttcgcagagaatgttaaccctaaatttttaaaatcttcgtttataacatccaacaaacggtctgtcctttttaaatcaaaccaacgatgcccttcaaaacaaagctccaattgacgttctttttctattgctaaacgtaattgactttgtgataatcccattagacttgaaacttgggcacgttgtcttatttggttgatatagggtagggcctcatttgtcttgttcaattcattcaaagcttccgcatacattaataatacatctgcgtagcgtaataaggtgaagttaactcctccatcttgcattgttgtcgcagaataatcaacgaatttcttgcaaaagaaataatcagtagtagttccatcgttcattggtaatttgtttcccaatccagcatctcttctgatatctccttcttcgtatgcgttccataacgttatactaggaacacatcttcctccaccaattattcctccaggaaaaacatccatattaatcacattaggatagaaatttccaaaatcaaatccttccccttgatttccagatgcaaattcaatttctaagatagactcaactttatcatcatttccttctgagaataatgaagcaaaatcagactctaaagaataagcttgcatatcaattacttcttttaatttttgaactgctagatcatattctttcttagttaaatagattttacccagtagagtttttatggctccgatggaaacttttcctttattggatggaatttcatcattagctaataatttttctgcgtctgttagatcatttaatatgagtttataaatctcttcaactggtttacgactaaaatcataattgttaatttcatttggacttgaaaattctttggtcgaaatagaaacatccccaaaaagacgaacaagttgaaagtaggataaggctcgaatgaatttgcattctccttccattcgagattttgatgtgaaatcgacattagacagtctgttcaagatagtattggctcgactgatcgtaccatagttgttattccagtagttattaacgtaagcatttgttggagaaagagtccaataatcgaatccagtgacatgggattctgcttgtggtaattggaatgtggcattatctgttcctacttcatttacccacattaaattttgcgcatacgattgtaaaccagaatagagacctactatagctgtttcaaaatcagcttcatttttccaatatcctaattcattgatctgatgttcaggttgtaatgtcaggaaatcagagcatgaggtgattgacagtgaaagtaaccccagacaggcatatgttattaaaacctttttcatgatattatagtttttaatttattaaaaagcgacttttaaacctaatgtatatactcttggtgttggatagacacctccatccatacctgcggatgtaacagagtctccagattgactggcttcggggtcatatccaggatagcctttagtgaatgtatatacattagagatattaaaatatgcatttaatcctttcattcttattttactaagcatttctaaagggaagtcgtaagaaagggttatatctttaatacgtacataggaggcatcaaagatatagcgtgaggatgcggattggcctaaggcataatcagaacgaatagctcttggaataaatccattacctggattttcagacgatttccaacgatcattaataagagcggattgattttgtacacctgcgagattcattataacttctccagcgccgaaataattttctgcaccatgtgagccattaataaaaacgcttaaagttagatttttatatctaaagctattggtcaatccccatgtgaaatcgggaaatggagaacctacgattgttttgtctgcggtggttatctttccattgccatctacatcttcaaattttaaatcaccaggctgggtgttaggtgtatatatgggtcccttcttcacatcctcttcatctttaaatacacctacaacatgcattaggtaaaaactggaaattgattgaccgacttcggtgatatatttgtcagagatgattcttccattttctgtcgctaatttcttaactttatttttgtttgtgctgatattgaatgaggtgttccaagaaaaatcctttgtgtcaatgtttactgtatttaatgcaaactcgaagcctttattttcgatttcacctacgttctgcatagaacttccaaaaccggaagcgattggtaaatttacgtttaataatagatcagttttcaaattgtaataccaatcagctatgatagagattctattttggaataatcccaaatcgatacctatatctgtttgttttgatttttcccatgtcagatcattgttagctaatgtactaggggctaatcccgggtatattttatttgcatttgcatagttggatattcctaaaagtgcgatttgtctgtaatcaccgatattattatttccagatacaccataacttgcccttatttttaaattggataaggctctaaggtttttcatgaaggtttcttctgagattcgatatcctacagaaatagaaggaaatgtaccccatctattattggatccaaaccgagagctaccatctctacgaacagtggcagttaacatatatttattgtcatatacgtaatttgccctagcaagcaaagagaccattgagctttcatttttgaagtgagttcctgtgttgattgttcccgctgataaataatgcacataatcagttgggaaatccgtagctcctgctgataattgcttataagtgtttttctctactgtaaaacctgcgactacgtttaaatcatgtttttcattgaagacttttttataagttaatgtgttttcatttacccaactcaagccttttttgtcaatggatgcagctgtagcaggacttgctttttctgcccaatttccaatttgagacgatttccaaagattagtttcattgagattgaaacttaaaccaaaggtcgtcttgaaatttaaaccatgcataaattcgtagtccagatagttattgacaataacatcttttttctctcttttatcggagaagttttctgcgatgaatagaggattttcaataggagcacccattggatctccaaattcagaattatagcttctatcttctgcgtaaataggtaagagaggattcatacctaatgcgcattgaatcatgcctctttgtcctagaacgccttctgttcgagcaaaatctccataaccataagatgctgcgatattggaaccaaattttagatgtttggttaattgagcgtcaatgttagatctaatattgaatcgttgatagtcagatccgattacgataccatcttgatcaaagaaacctaaagaaaccatgtattttatattctcagttccaccggttgctgataattgatagttttgtactgtagctaaacggaatatagcgtcttgccaatccgttccttcgttagggagaagttcaggattacgaaattctggtctaacccaagtgttggaagttcttacgtcattgggatcactggctttgcctcctgcgtaaatccatgcgttatctctaccttccgctacataggctgcgtattcacgtggggagagcagatcaactttatgtgctacttgttgtacaccaatagaggcatctatattaatggttgtttttccaacttttcctctttttgttgtaattaagacgactccattggctcctcgagatccgtagatggcagtagctgaagcatcttttaatatctcgattgattcgatgtctgaaggattaattgtgcttaaagggttgattttttccatggtcgaattcgccataccattagctgtgtaactattgtttgcgaaagcagacatgttggatcctcctcctccgttaccaatagggtaaccatcgatcacatataaaggtgaatttgatccggaaatagaactgataccacgtaccataatattgatatttccaccaggagctccagtagtttgcgtaacttgtactcctggaatttttccttgcaatgattggtcaaaactagatgtaggtgtttttcctaagtcttcgctactaacagaggcaatggctcctgttaaatcttttttcttctgtgtaccatatcccacaacgactacttcatcaagtacctctacatcttctattagtatgatattgagtactgttttgtttccgactggggtttcttgtgatttataaccgatgaaggaaaaggatagtataggattctctgtggttagattcaacgtccagtttccttcaacatctgttatgactccgttggttgttcctttttcaatcacgtttacaccggcgattccgtaaccgtctgtgcctgtgactttaccttttattgctccgggtgccgcataagctactatattataaaaagcaaaacaaatcaagaatatcaagtgggtaatttgcttgtatctgataggggacttgttaactgtttgaattcgtttttccatgattctcagatttaaattgaatttagttttaatcagttggtataatcttgtattcaagatttaagtatttagccaatttggctaaagtcgctgcatgatgtccgatacctaaggcgaaatggtgcgtaggagcttcattaacccatcttttcaggaatgtccgtacatcgggttgaaagaatcctcttgtgttcgtattgccggtaggaggtatgggaccgctaacggattctccttctgcgatgatgaatttaaattttccatcgtaggtggaattgatagataaaagcgtgataggaccctcctttatcttgaattctacacctgctccattacctggctttccatgatatttttttaggctgcgtaataccggtttgccttccgctatcgagatgttgtgcgggccgtcatgtcctactaatacgaagccatcagtaaagtcgaccggatgaaattctgcgaaactgccacctattcccatgtgatccatgatcatcaacgcaatcaaggtttttaagtcagactcaccacacatcgggatgtgccgggcggttaataaagagtttcctacgatcaagtttgtcattaattgacgtattgaactgttctccgctccatcgaaatagtatgcgaggccagtcagattgttactgttgacaaatttgtctaaagccagactggctttcgctgccacgcacaagtcctcgtcacttagtttcatggagattggatctgatacaggttccggcgtgtcgaagaattggagtatttgtttttctttttccttaatttcttcgtccgtgagcgacttcatgtgacgttgtaactcattaggctcataaaagatgacgtgtgagccaaaaaaggtcgtgagcatcgtggggtctgtattcatatccagcatggagttgagaggatggccgatatgtcccaattgtgcattcctcaaaccatgcaatacgtttgcgattcggcagtattcgtatatctcgttatctaccatttcgtcatcgtgtaaggtgccgataattgtttctggaatcggtctgcccaggcgagaggctacacccgtaaactctggtaaggcacagatatcatcgtttaccagttgcatatacgtgctggcctgtttgtagtccatcgcttttaacggttgcaaggcgaccaaaacaatagggcatcgtacagaggccgcaatgacaccaaacgtaccggaagttgcgtaagtgagcatatcgcaaaagaggaaatcaaggtttgctgcgatgatttctttcacttttttataggcgacagcaggggaatcaatcatcccgaaacgaatgatatctacttcgttttgaggaaatttgcggataaacatctcttctttcgccaagagttcttctaataaacctgggaattgcgcccaatacacatcatatccgacactgaatactccgatacgagctttcccttttctcttctctttcattctgtccatattaacgtttgtttgtttgatagttaacgcactatgttgatttgtatgtaatgttacaatatgagtctgtatacgcttgtttattttcccgtatggataccttctcgtaaaaagaaaaggaagataagaaaagcgatagggtacatgatacccgaatagatccacagaggcgcataggtataattggttattacaacccccatgagaggattgataaccatggatgataccgcacctgctgttccggataaacctacgaccgtagatgattttgtcgcgccaaagatatcaccaattgaggttatatagtttgtgatccagatgccatgtgcgaagaaagctaatgacatgacgaacatgacgatcaaggaggtattaagcataccaacggaaagaacgggcagggttaagactgctgcgattcccatggcgatttttctcgcttggcttgtgttgcctgtcttcttttgtatttggtctgatagccaaccgcctataatatttgcgatacccaaggctaagaatggaatccacaaaatattacctatataatcaagggaaagacctttggattcgtttaagtatttgggaatccagaacatataaaagtaaaagatgggatctaacaggaagcggatcaggatgaacaaaagagcgtttttgttctttagtaaatggatgagatccgagagctttaagggagaagccacgctttttgtcgcagtattctgctctttggaatatttgtttgtcagtcgtaaccagaaaagcacccaaattattcctaaagccccgctgattaggaatagcatgcgccaattggtatggcttaagatgaaagcgcaaagaggaactgccactaccgctccaatagcagagcctcctatggctattccgtttgcgatggcatgcttgtggctgggaatccattcgataaccgccttgatagctccgggaaaacatcctccttctcccactcccagtaaaaaacggagtgctccaaagtggaacgtatttgttgaaagagcatgtaaagctgtagctaaagaccagaaccctacagagaatgcaagtcctaggcggcttccgtatctgtcgattaacacacctcccagcgtgaacatgatcgcatagctgataaggaagcctgaatttataaagccatattccgtgtcggtgatatgcagatcgtccttgatccggatgatggagatggatagaatctggcgatccatgaagcttaaagcggtcgcaagcaacagcatcaacgagatgagccagaatattcttctttttggggttttcatacttaacgcacaaagtttgttttttgcaaatatatgaggtgtatattaaaaaaacaagtttcgtgaagtttttttgaaaaaataaatgataaaaaaataaaacgttgtatatttgcggtatataaattatgtgtgctgctgtatttgttagtgcataaagtttttgatataggtttaaatagtagatgatgaagaacaaatatccgaaatatctagagataagtaaagcgattatcgctaagattgaatcgggagagttgctcccgggcgataaggtcccttcagaaaatgagcttattaatatgtataagataagtaatacgactgcaagaaaaagccttttagaagtagagttacaggggtgggctagccggattaaaggtaaaggcacgttcgttttgaatcgttctgaggataaacatcttactcgtatgttaggatcttttcacgctataaaggaaagctttaatgagaatctgatcaaagagggattcactccgaaaaatgtgacattagagaaaacgattatagataatggtatctctatcaatatcaatgggaaaaattatattatcgaagggaaaattctaaaaatacgtcgacttcgttatgcggatgatctattactgaaggatgagacacgatatgtttctatgtctctttgtccccgaattaatctgatggagcttaatcaggcgtttttgaaaatttacgaggataagtatcatttacaactagatagtgtgcaaagaacgcttggtgtaacgatagtttatccagaggaggagaacaattatttcgaaaatgatcttcagcttcccgtgtttatattggatagtgtggtagtttgtgagaatcaaaaagtagtggaaatagagcattctttttatcgaggggataaatataaattttccctacacaccaagccgcaattgataactagcaatggacggatttcatgaggatagtcaggtagtcaaagttgtttaaatctatccctaaaaacatgtacgtgtttccgcgaaaacatgtacatgttttttagaaaacacgtacgtctttttttcaaaggttcgtcagactcgatttttctatgtacatttgcgtgttataaaagaattattgagaaactatttatggcaaagaagacaacaacaacgaagcaaaatcatacagaaccgagctggttcgctgccttgaagactttttttacaaatgaacggacccgtttcattacaggtttgattatctctatactaaccatttacgtagggcttgccttgatttcgtttttctttacaggagctgccgatcaaagcaaaatagagaatgttcctttaggtgatttattgatcaatcgaggatcggtagagaattggacgggtgtacgcggggcgtatttgtctgatctgttgatgaatcgttggttcggtatctcttcttttatgatcctctttttcttgggatcggttggggcgaaactcatgaacttaaataaagtatccttgttgaggcgttttttgtttagcgcttcggcattgatctggggatctgtgttttttgcttttatatttatcaagggatatgaggatacgtttatttatctaggcggtcaacacggatattatatctcggagatgtttattaccaatatcggaatacccggtacgattttacttttattaggctcattcttaatcatcgctatttttaccagcaagaagacaatcccgttcttacagcgcgtattttctttaggttgggtgaaagatcgtttgaaacgtgaaggcgaggtagatgtcgatcagacggaaaaggaggataatgtaattcctcgctctaagcctgtcgtagagcaaccggatgaacaaccggaaatggatgagtatgaggagttcgatacggaggctgaattgttgaaggccgaagagaaagaaaaacgtaaaacagtaccggaatataagaacgaagaggtcgctgttgctgatgatttagtagttacgatcgctcaaggtgacgacgatccgataaatgaaaagacagatgagataaataccccggagtcagaggatgaggaggatgcaggatttacggtggaagttgccgccggtaatgatgagacctacgatgcctcggccttgggtacgtatgatccccgtttggatctttcccgttatgtattccctaccttggacttgctgaaagcgtatgatagtgggagcatggagatcaatcgggacgaattggcggaaaaccaacgcttgatcaagcaagccttggaagatttcaatataaagatcgcttcgatcaaagcgacagtcggacctacggttacgctttatgagattgtacccgaggcgggtgtccgtatttctaagatcaagaacttggaggatgatatcgccttgagtttatccgctttgcagatccgtattatcgctccgatgcccggaaagggaacgatcggtatcgaggtgccgaataagaatcctcagacggtatcgatgcaatctgttatcgcttcacgccgattcattgagggtaagtatgagttgcccgtggcgatgggtaagacgattacgaacgaggtgttcatgttcgatctttgtaagacaccgcatctattggtagctggtgctacggggcaaggtaagtctgtcggtctaaatgcgatcatcacttccttattatataagaagcatccatcggaattgaaattcgtgatggtagacccgaaaatggttgagtttagtatctattccaagatagaacgtcattatctggcgaaacttccgaatgcggagaagccgatcgttacggagccagctgacgctgtcgctacattgaactcgttggtgatcgagatggaagaccggtaccgtttactggtgaatgcgaatgttcgtaatataaaggaatacaacgctaagtttatcgaacggcggttgaacccgcagaagggacatcgcttcttaccctatatcgtggcagtggtggatgagtttgccgacttgatcgcggtggccggacgtgagatcgagttgcctatctctcgtattgcggcgaaggcccgtgcggtaggtattcatatgatcttggctacgcaacgtccggatacaaaggtgattaccggtacgatcaagagtaactttccgagccgtatcgcctttaaggttgcttctatgatcgattcacgtacgattctggatgctccgggcgctaaccgtttgatcggacggggcgatatgttgattgtcgtggcgggacaagagccggttcgtgtgcagtgcgctttcgtagatacgcccgaggtggaggatatcgtggattatatcggtgagcagactggtttccaaaccgcttatttgcttccggactatgtaccggaaggtggggaggcatcgacttcgggtgcagtcgatttatcagatcgagatcccttatttgacgaggcggctcgtttgatcgtgattcagcaacaaggttctacttctttgatccagcgtaaattcgctatcggttataatcgtgccggacgtttgatggatcaattggaagctgctggtattgtaggtccgtttgagggcagtaaggcccgtcaagtattggtgcaagatgagtattcgttggagcaagtattaaatgccttgaaataaatatgagaagagaacataaaataagagtgtggcggtgtatcgcatttgtcggattattcttgtgtttcctgttgggactaggagtgggggcgcatgcccagaatgcgaatgatatcttggggaaggcggctgctgcttatgagaattcgaacgggataagcgcttcttttacgatgtttacccgttctgccggtcagaatgcgggagagagttttgagggaaccatccagatgaaaggtgataagtttacattagtcacgccggatgcgcttacttggtttaatggtacgacgcaatggacctatgtggagcggaacgacgaggtgaacgtgacgaatcctacgggagaggagttacaatttacgaatcctgctcttttattaaatagttataagaaaggattctcggcaacatataaaggcgagagtacggcaccgaacggaaaagccgcttatgatgtggaattgacaccaaagaaaaaaggggatatcgtgaaagtggagttgcaaatcgagaaatattcaaatttcccggctcgtatcacggttacttctaaaaacggcgttagtagtacgatccagatcagccaattgaaaacaggtataaaccaaccggatcgtttttttgtttttaacgaagaggattatccggacgtagaggtgatagacctgcggtaattgaaaattgagaattgaaaattaaaaattaatactttttgttatgagcgattcagtgaatgagaaagtacgttgccttattataggctcgggtccagcaggttatacggcagcgatttatgcttcccgtgcgaatttatctccggtgctttatgaaggaatacagccggggggacaattaacaacaactacagaggtggagaatttcccgggatatccggacggtataaccggccctgagttgatggaggatttaaaaaaacaagccgtccgttttggtgcggatatccgtttcggtatcgctaccgctgctgatttgggtgtggctccttataaaattacgattgatggcgagaaagtgattgagacggagactctgattattgctacgggtgcttccgcgaagtatctgggtcttccggatgagcataaatatgcgggtatgggtgtatccgcttgcgctacttgcgatggtttcttctatcgtaaaaagacggtagcggtagtaggtggtggagatacggcctgtgaggaagcgatttacttggctggtttggcaaaacaagtttacttgatcgtacgtaaaccctatttgcgtgcttcaaaagtaatgcaagaacgtgtcttcaagactccgaatatcacggtgcttttcgaacataacaccctgggtttatttggagagaatggcgtggaaggtgctcatttggtaaaacgtatgggagagccggatgaggagaaagtggatatcgctatcgatggtttcttcttggcgattggccataaacctaattcggatatcttcaagccatggatagatacggacgagatcggttatatcgagacagttccgggaactccccgaacgaaagttccgggtgtgtttgctgctggagatgtcgctgatccccattatcgtcaagctattaccgctgcgggaagtggttgtaaggctgctatcgaggctgaacgttatttatcagagatcggaaaatagttggcagttgacaattgatagttgacagttgcgacaagcggtatttaactgtcaactttcacttgtcaactatcaactgtcacttgtcatttgtcaactaatttaatttccatgaatttaaaatctactcttcttttgctactttgcctgatgatggcaggaatggtagcggcaaaggataacacgaaagtgatcgcccatcgggggtattggaaaacggagggctctgctcagaactctatccgttctttggaacgtgccagcgagattggtgcctatggctcggaattcgacgtacatcttacggcggacaatgtgctggtaatattccatgataatgatatccaaggaaaacatattcaatcctgtacttatgatgaattgaaagatttgcaattgagcaacggcgaaaagctccctactttagagcaatatttgaaacgtgcgaagaaattgaagaatgtccggttaattttagaactgaaagctcatgagaccccggaacgcaaccgtgaggctgttaaagctgttgtagatatggtgaagcgtatgaaattagcgaaacgtacggattacatatcttttaatatggatgcttgtaaagaatttatccgtctatgtccgaaatctgaggtttcttatctgaatggagaattatccccgatggaattgaaagagcttggttttacaggattagactaccattataaagtcttgcaatctcatccggattgggtgaaggattgtaaagtcctaggcatgacttcgaatgtctggaccgtagatgaccctaaattaatggaagagatgatcgatatgggagtcgattttattacgactgatttaccggaagagactcaaaaaatactacattcgcgggctcaataaggcattataaagatgagaaagttttgtctgttgcttatcctgtcgctggctttacccgttttttgtctgttacaagcggtagagcctcccaaaaaggaaattcgtgcggtttggttgactacggtttatggtctggattggcctcataaaccggctactaccgaggcgggacgaaaagcccagcaacaggcattgcttgatatcttggaccggcttcaagaagcgaattttaatatggtcttcattcaggctcgcttgaggggagacgtgatgtatcgttcggctatcgaaccagtcagtaagacattctccggtaagtatggagaattaccgggatatgatccgctcgcttttgtcgtggatgaatgccataagcgtggaatggaatgtcatgcgtggttcgtaactttcccgctaggaacggaaaaaagcgtgaaggagcaaggaaagctttccgtggttaaaaagaaaccaaaactctgcaaacggcataatggggagtggtatttggaccccggcgtaccggagaccgctgattatatcttatccttagtcaaggagatcgtgaatggctacgatatagatggcatccattttgattatatccgctatcccgaagaggcgaaaacattcccggataaagcgttgtataatagatccggtaagaaaaagtctctggcagactggcgtagggagaatatcaaccggatggtttaccgtatttacgattgggtaaagcaaacgaaaccttgggtgcaggtgagcagttcgccactcgggaaatataatcgtattgaacgggtacctaacgcgggttggaccgcttacgaaagtgtcttccaagacccgaagatgtggatgcaacaaggtaaacaagatatgattgttccgatgatgtattacctgcataagaatttctttcctttcgtggataattgggtggataattgtaacgggcgtttggtcgtacccggcttgggagcttatcggatggacaagagtgaggcggactgggccgtgaatgatataacggaccagatcgattatagccgttattacggaggagccggctgtgcgttctttcgttgtggaaatgtcctgtataatgacaagggactttataaagagttgagagacaattactataaatatccggcccaattgcctccattgacttggctgaatgattcggtacctgccgcaccggaggggatcaaagtggaacgtttggacgatgagttgcacttaacttgggagaaacctgtgtcggaaaagcaggacttaacttataccgtttattattcattgacagattcgatcgatacggcttcggcaaaatccatattagctacaaatatttatggcaacgagctttttcttcctatcgatgtagagtctgaacgtgggtatacattttctgtaacggcttccacccgttaccggatagagagtgaaccttctccggatacctattattacctgtctaaatttatcaagtaaagggggtattttgatttcgagtttttttgcttatttttgcggcatatgagacgatttgccacatccttgtttcttgtaattcttgcttccttaatcttttatgggggagcgggggttaatttcgtatcttattgttgtggcgtttgcgagaaagagggagtggaggctttattggaagctaagtgctgtgagattcatggacatgatcatagtcgtgataatcttgcgaataatacggtggagtgttgtggcatgaacggctgtggcattgaacgggttgattttgattggaattctgtaaatatacaagtgccggatctgcaaccagtcgtacatgatttgctcttttcctctattttcgagagtttacaaatcgcttccttatttgctgattcctatgagattagggtgacaggtcctcccgtagcctgtcctcgtgtgtacctttctttattgactacgcttttgatttgattgtattcgtgagggtggaagctgctcgctgaataccctttggtttttaaggtaggggatgctctatccctgcggaagcatgtatttaacgattcaatcaaataacaactatcatgttaagacaattatatctgatatttttattgtcctgtttgacttttactttgacttgggccgaggattccggcaagaaagtgaaaggacgtgtatgtgatgaaaacaaacaacctattatcggtgcaaatgtatattgggaaggaacccaaaatggaaccacgtccgatgtggatggaaatttcgagttagaacgaaaaggtgactccaagaatctggtggttagctatatcggttatatgactgaggtcacccctgtggatgagaaggacgatgctatgcagattatcttaaaaggtgagatcgccttggatgaggtcgtggttagtgagcgcaagatgggaaccatcgcttcccgtacgagcgtattgcaaactcagaaaattacgtacgatgagatttgccgtgcggcctgctgtaatctggcggagagctttgagacaaatccgtctgtcgatgtatcgtactcggatgcggctacaggtgcccggcaaattaagctgttaggattggcgggaacctacgtacaaatgttgaccgagaattacccgaatttccggggggccgcttccttatatgggctggattatgttccgggagcttggatggaaagtattcaggtgtctaaaggaacctcttcggttaagaatgggtatgaggcgttggccggacaaatcaacgtggaattcaagaagccccctacggcggatattttctctgctaatgtgttcgctagtgatgccggacgttatgaagggaatgcggatgcttcttggcatatcaacgacaagctctcttccggtttattggtacactactcgaatgataaaatgcaacatgacggtaatgacgatggttttctcgatacgccgctaagggaacaggtgaacgtaatgaaccgttggtatcataaattggataaatacgtggctcaatacggagttcgctatctgcatgagagccgtaccggtgggcaggatacgaaacaccatgatttcaccgacccgtatcggattcatttaaatacgaaccgggccgaattatttacgaagcaggcctatattatcgataaggaaaaggtagagagcgtggcattgatactttccggttcttatcatgagcaaaaatcaagatatgaccgtacgccctataatgtatatcagaataatgtatatgccagtttgctgtatgaaaaggagtttacgccgatgcatagcttgagtaccggattaagtatgaactatgatggtttcgacgagaatctggttcaatatgcgggaggagagtcggtccgtcatgcctatgaccgtacggaagtcgtgccgggagcttatgcccaatatacgttcaatctgaatgataaactgatcttattggcgggtgtacgtgcggattatagtacgttgtatgatttctttgtaacccctcgtgtacatattaaatataatccttttgactggttccatatccgggcttcggcaggtaaaggattccggacagcgaatgtgctggcagagaacaactttttgttatccagtagtcgaaaaatgtatatcgccgacaatctggatcaagaagaagcgtggaataccggtctgaatctgtcattttatatacctttgttcgggaaggaactgagcttgagcggggaatggtattataccgatttcttgaagcaaatcgtggtggatatggatagtgatcctcatgcggttcgtttctacaatctggatgggcgttcctattcgaatagcttccaagtggaggcttcctatccttttttccggggatttacgttaacggccgcttatcgttatacggacgcgaagaccgattaccggaatgaggagggtgtggcgcatcgattgaaaaagccgttggttagtgattataaaggtttattgaccgcttcttatcaaaccccgttgaaaaaatggcagtttgatttgaccggccagtttaatggaggcggtcgtatgccgataccggatgcgtctaatccgttatgggagccgaattttaaggcttatacggtagtgaatgcgcagattacgaaatatttccgtcaatggtctatttacgtgggagcggagaacctgtttaattacaaacaaccgaatccgattatcgatgccagcaatcccagaggggataacttcgatggatctatggtgtggggaccggtgcatggacggaaaatttatgcgggtatccgctttaatataagcagggattgacacgtatatacgtataagcccgtacgtatatacgtgtaggcctatgcgtatactggtgtgcccctacgcctatatacgtgtagcccgatgcctatagtggtgcttttcttttggtagatatgaatggataattagaactgttaatattaaaaaacaattgattatgagacgattaattatgttgctattttgtgccgtatgtacggtatcgatgacattcgcccaagaagcgaaaaagaagaaggactctgtgacattctttatcgaagcgatggattgtgatcactgtatcaagaagatcgagaaaaatatcgctttcgagaaaggagtgaccgacttgaaatgtgatctgagcacccgtacggccattgtgacttacaagacggataagacttcgaagacccgcttgaccgcggccttcaaaaagatcggtatggaagcggttccggtagataatggcgccggctgtccggtacctccggcgaaaaaaagtgagcatactcacgctcattaacatggaaattcataagaacatcttatctttgcagatgttccgtgagggcgggccggagtgtccgccctgtttatgaaataatttttctacggaatgcagcgtttgtttaattatttacatcctaatattgtacagtctccagaagggagacgttcaaggcacgactgaatgaatgagctacaactgatagagggttgtcggaagggggagagacgagctcaaaaagagctttatgatgcgtattcccgaaaaatgatgggagtttgccttcgttatgtgaacgacagggaaacggctcgtgatttgttgcaggatggcttcgtgaaaatctttaccagtatggattcctatacagggagtggttcatttgaggggtggatgcggaagatctttgttaattgtgcgttggaatatctgcgaaagtcggatgtgttgcgtgaagcgaccgatcttgacaatacggcggaactgattcaacccgatagttcggctatctcggacatgtcggcggctgagttgatgaatctagtgaaggagttgccggttggcttccgtaccgtattcaatatgttcgcgatagagggatattctcataaggagatcagtgagatgttgaacataacagagagtacttcccgttcccaatatacccgtgccaagcagttattacaacgtagaattaacgcattgtattgagataagatgagtaaaaaggaaagagatatatgggatgacgcgatccgatcgaagctagaggatttcgagatggatacgctacccggcgactgggaggctatagccgatcgattgcccggaaaggctccggttcctttgcgtcgtacgcttcgctactgggttgccgccgccgtgatctccttattggtcgtatcgggtggtatctatttatatgacagggagatggaagatctacctatagcccaagaaatacagtcttcacaagagtcgacatccgtggataccccggttgttccggtagagaaaacgatggagcaagcgcccgtattagcgactattcctgctgctgcggtcgtgaaggcaaaagcggcatctggagcggttaaagtgggagctaaggctaggatggcagcgttccggcaaaatgtagagagtgcagaggatcggcctatttctgagtcggaggtaatgtctgctgatagatcggcgaatgagaaagataccgttgaaccggaggttgaaaggaataatgatgagatagttgttctcaagaatgatgtacttgtcgcagatgctactcctgttgctaaaaagaagctggagaagactgcgtcccggaaatgggggttcggtatgggaggtggaggtctttctatgggcgctgataatctggtccctcagtatgtgacgaatagcagcgtgcttaagagtgagaatctgatgagcttaaattcgttcgatgcggagaagaaagatcctgctaagacggatattcatcataagacgcctattggggtgggtatctcaattagtcgttatttgaataatcgtttttctttgcagactggattaacttattcttacttaagatcggagtggagtacgaataatacgtaccatatagagaatgatcagcgattgcattttataggaattccattatcattgacttataagatcgcggaatggaatcgttttatgttttacgcttcagccggaggtatggcggaagtgaatgtcgctggcaaacgtagaatgaaattattctcggatgaggtagagatcgcaaagcaaagcgaacatattcgaatgaaagaatggctatggtctgtaaatgcccgtgcgggtgtaagttatccgattatccgttttgtaagcgctttcgctgaggtgggagccagctattattttgataatggcagcgagatcgaaaccatccattcggagaagccgtttaacatgagccttcagtttggatttcgttttggtttttaatactcgatagattaacagtgtaaatacaaatacttaaaaatagaaaaattgaattatgaaagcatttaaattaattggagcagcggcggctgcgtcattattgttgttgacctcttgtcttggagaatcgaataatacggtgactcgtgccggctttggtgtcgcaggtctttctgaaaagacatataaaacggtactgaatacaaatatgggagcattatactctccgtctttatcggcacaagtagttgacggagcttgttacttgatcaactatgaattagacctaaattctccggagaatgcgaatgcggcgacaaatggttatttaacagcgacaatctctgtggcagatgagataacaaaaggacagccagtcttttataatgtgccagattcggccagcttacttcagaatgagatacctgtaaaaaacctatttagcaatggcgactatggggtgtatgtagacggttatttattcttctttataacaatggatatgtttaaggatcagaaaaattcttatactttatattgggatcgttcaaaggagcctactatggtggataatgtcccgacatatgacttgttcttgcgtgtcgctaaagtagcggacggaacaggttctgctgcatcatccataggagaagtccgtgcgtttaatgttaagtctgtattggagtctgtgaatagcgctgaggctaataaagattcaaagtcttttaatcttaaggtcaattatctaaatacgattaatgaaaaagatagtacggatttgaaatgggcttcttataccgttctattccaagtcgtgaaaaactcataaagaaattagtatagaagttgagggcgtaccgataagaagattatcgatacgccctattttttgccgttttttttatgtatatgggtaaagatcgtatctttgcgtactttaagaggagtattgtgaaatgagatacaagaatttaataggttttgtctgggtggcggttatcatgggtctgtttacctcttgcctaaaagacataaataacgtctataatccgggaacgaccgccgctgtggttcgtcaacatggagatagcgcgttgatgatggctaatacccggttcggttggatctatgcgacgaagctgagctcatactcagagggtaaatgcttgttggtgagttttgattatgatcctagcttgccggaaaatacgggtgcggaacaaaaagggtattatacggtgacgatacaaggggaaaccgccgttaaccagcaaaacgctgagagtcctcttacggatacgcataaactattgacaaatgagcaaccgatacttgcggttaatccgaacgactctgttctgtacgtcaaattggaagattatttgtttttgccttccgcctgttggacaacaaaagaccgggctttaaattggcaactgacttatgatccgactcaacaaccagttgttgaaaatcggaaatcaatttattccttatatttacgggctgccgctacgaccggaaagccggaggataaggcagaggaggctatcgcggttatcaatgcctttaatctggcgaattttatcaaggatatgcgagaacaaggtggacgcgacgcggatatgtatgttcggattcattatatcgatcaaattaatccgaaagatagtacccagtttacatggggagtaacagatcctttacttataaactaaagaagatgagaaagcgaattttatacggcttatttttatccttatttttcttaatgacctcttgtatgggggatggaagtaattccatcaattatcatcgagtaggagtgatacgtgagaatcctatgcgatgtatctacacggcggatgatcaaggggagatctttatcgtctcttcctctgagtttgagaatcggacggatttgaaagatggcgactgctgtgtggttgatttcaagacgaattttagcgaggaattgggcaatggtgtttacaacgctgagatttataagtatgattcggtcgctgtatggcctttgcatgagacattgactgatactacggttgtattggacaaggagcgtctggttacgctggactttaagaaaagtatttatttggaaggacgtttcttcttgcaaacccaacatgtaaatcatcaggtagaccaaaaggatattttcaatttatcctataaccctgatcaggaggtggaaaaagatgatgacggacaacggatctataacctatatctccgggtaacccaagaggggggtaccggcgattccactaaatggatcaatacgaccgcttttacgatcgataagtttttggaccaagccaaagcgatagagagcagggaggggcaaaatgagataaactttaaaataaattatgccgaacgctataatgcggatacaaccgcatgtgtttggggggctaccgacgtatttacgttgcgttttacgaattaaatatatacttttgctatttaaaagtaaacagagatgtataaggagatatttaggtgggtaatcgctatcatctcacagccggcgaaggcgtgggtcttgttagcgaaaaaaggagagaagcaggaggagttcttatcccgattcgtgtatcctttgatcggcttcgttactgtcgcggcttttctgggcgtattgtttacgcggaaggagtttgatttagagctggccttgaagtcgtctatccggacattggtgtcctcgttcggtggtttttacctcggggcttatctgatgaacgagatatggcaaggtatatttaaacgggagaaggatttgaaactgtggttgcgcttcgtcgggtattcctcgtcgttgatgttcgctttgaatatcgtattgatgttgcttcccgagtttttcttcttgcggatatttatcctttatacattttatattgtttgggaaggcgctggtccttatatgggagtcgaggagaagatccgcttgaagttcgtaggatttacaaccgccataatattactgactccggtagttatcgagattttgttatcgatgctgatgcccggtttgagtttttgacagaataacacaagatgaaagagaagattagtaataacatacagataaagaataagcgggcgacgttcgactacgagttgctcgacacttttacggccgggatcgtactgaccggaacggagattaaatcgatccgtttagggaaggcgagtttggtagatacgttttgtatcgtggaaaaaggggaactgtgggtgaagaatatgtacatcgccgaatatttttacggtacgtacaataatcacaacgcacggcgggaccggaaattacttcttaccaaaaaggaattacgaaagatcgagggcgccgttcgtgccagtggttttacgatcgttcccactcgtttgtttatcaatgagaaaggattggcgaaagtagtcgtcgcgatcgcacgaggtaaaaaggaatatgataagcgagactccatccgggaacgtgacgaccgacgggagatggatcgggctttcaaacgataagtcgagatggaaacagggcaaggcgtgatcggtagggtttggggatgtatcctgaaagctctgcctaaagcaggcaagacgtgtttatggctgctaaagattattttgcctatttctttattggtccgtatattgcaatattccggaatattaggtcagatctcggattggttagtgcccgtgttctcgttggtgggtctgccgggggagacagccattgtttttataaccagtatattctccccattatatgctccgatcgctttgatcacctcgatgtctttaggagtccgtgaagctacgatattggcattgatgtgccttacttcccataatctaatggtagaatcctccgtacaggcaaagaccgggtcttctttctgggagatgacgctgctccgtttgatcatgagtttcgtgatcgccttttctttgaattgggtaatgccccatgaaggatggggacaggtcgggatcgctcaaagtgcggctgtatgcgataattggttggaagtattcgtactttggtttaccagctcgatgaaggtggtgatttctattttgataattgttacggctttaatgatccttcattatatattggaagagtttaatctaatgaaaggattgtcctcggtcttttctccgctgatgcgattatttggcttgcctcaagatgccgcttttttgtggttggtaggtaatgtggtcggactggcttatggcggggctattatggtagagcaaatggagcagaggaagttgtcttacggtgacggcaacttgctgaaccatcatttggccgtgtgccattccctgttggaagatacgatcatctttgccgcgataggggtacccgttctttgggtggtgcctacccgtctgtttttcgccatcgctgtggtatggatcctccggggatatagttatatgtacgcaagaaaggtaaaacatatttatgaataaggaacgatttctgcgactcttgaatgagcgcattttgatcttggatggtggtatgggtaccatgatccaaagtttcaaactaaacgaacaagattaccgaggcgaacgtttcgccgattttccgggacagttgaaggggaacaatgatttattgtgtatcacccgcccggatgtaatccagtctattcatcgtcagtatttggatgcgggagcggatatcttcgctacgaatacgtttaatgcgaatgctatttccatggcagattatgcgatggaggcctatgtacgtgagataaatctggccgccggccgattgtcgagggaagtggcggatacctatatggcagagcatccggatcgtacgatcttcgtggccggatcgatcggtcctaccaataagacagcttccatgagtccggatgtaagcgatcccgcttatcgtgccgtaacttataaagatttgtataatgcctacaaggagcaagtcgagggacttgttgatggcggggtggatatcatccttttcgagactactttcgatacgttgaacgtaaaagcgggattggaagcggctgaggtcgtgttgaaagagaaagaaaaagacctgccgattatgttgtctttgactttgtctgcgcaaggtggacgaacattttccggacagactttattggccttcttagcttccatacagcatacacatattgtttcggttggcttaaactgctctttcggagcggcggatatgaagccctatttacaagagttggcgaagtatgccccctattatatcagcgcttatccgaacgccggattgccgaatagttttggtacctatgacgagacgccggataaaatggcccaacatgtgaagccttttgtggaagagggattagtgaacattatcggaggctgttgcggaacgactccagcgcatatctcccggtatccggagttggtgaaaggagctaaaccgcatatcccggctttgaaaccggattgcctgtggctgtcgggcttggaactgctggaggtgaaaccggagaataatttcgtgaacgtgggagagcgttgtaatgtggccggttctcggaaattcttacgcttgataaaagaaggcagttatgaggaagcgttgacgatcgctcgtaagcaagtggaggatggcgcccaagtgatcgatatcaatatggacgatggtatgttggatgccgtgaaagaaatgaagacattcttaaacttgatcgcctccgaaccggatattgcccgtgtacccgtcatgatcgattcttctaaatgggaagtgatcgaggaaggcttgatgtgcgtgcaaggaaagagcatcgtgaattccatctccttgaaagaaggagaggaggtcttccttaaacatgccgcccgtattaagcaactgggtgcggctgcggtcgtgatggctttcgacgagaaggggcaggcggatacctatgaaagaaagattgagatttgtgaacgggcctatcgcctattgatcgagaagatcgatttcaatctccaagatattatttttgacccgaacgtattggcgatcgctaccggtatggaggaacataatggctatggtctggcgtttatccgtgccgttgaatggatcaagaagaacttgccgggtgcgaaggtgagtggtggtgtaagtaatttatctttctctttccgggggaacaatcatgtacgcgaggctatgcattccgtatttctatatcatgcgattgggaaggggatggatatgggtatcgtgaatccgtctacctccgtactttatgaggatatagagccggagttccgtaccttgttggaagacgtgatcttggcacgccgtccggaagctgccgaggaattaattacttatgctcaaaatttacatgttcaagcttccggagaaactccggagaagcatgaggcttggcgtgagctttcattgaaggagcgtttggagcatgccttaattaaagggatcggagactatttggaggatgatttacaagaagccttgcggacttattcgcatgccgtggatataattgacggtccgttaatgagcggaatgaataaggtcggcgagttattcggtgccggaaagatgtttctccctcaagtcgtgaagaccgcacgtacgatgaaaaaggccgtggctattttacaaccggccattgaatctgaaaagaaagcttccggctctgcgaaggccggtaaagtgattttcgctacggtaaaaggggatgtacatgatatcggtaagaatatcgtctctatcgtattgtcttgtaataactacgaggtgattgatttaggggtaatggttcccgcagatgtgatcataaagaaagcgatcgaggagaaaccggatctggtttgcttatccggcctgataaccccttctttagaagagatggcgcatgttgcggacgagatgcagaaagcgggacttacgattcctatgatggtgggtggcgctacgacctccaaattgcatacggcggtgaagatcgctccgcattatgattatccggtgattcatgtgctggatgcctcacagaatccgttgatcgccgccaaactattgaatccagatacccgtgacgcttatatcagggagttggaacaagaacaagaagccttgcgtgcctctttagggcagaagaaagagaccttggcttctctttcagaggctcgtaagcatccgatagaaatagattggaccgggtatacaccggttgttccggcccggatgggggtacatgttatcccttatatccccttggaagaagtgattccttatatccactggaccttcttttttagcgcatggaaattgaatggccgtttctcggaaatctcccagatacatggttgcgattcttgtcgtgcctcttggttggccggattcccggaaaaagatcgtgcgaaggctaccgaggcgatgcaattatacaaggatgctgttaggttattggatcggctggtcaatatgaaggttgaatattgtaaagcgatttacggatttttctcagcgaatagtgaaggggatacgatccgaatgggtgatatagcgctgcctttattacgtcagcaagtaaaaaaagaggaaaatatttataaatgtctttccgattatgtaataccggtttccgaggagcgaactgattatgtaggggcgtttgtcgttaccgctggagctggcgctgattgtttgaaggataaatttgaggaagaaggcgatacctataattcaatgttgctgcaaaccttgaccgatcgcctagcggaagctacagccgaatatcttcatgagaaagtacgtaaagaatattggggatatgctaaagacgaatccttgtctatcccggatctttacaaggtgaaataccaaggaatccgtccggctatcggttacccttctctaccggatcaattattgaatttcacattggatggattgctcgatatgtcgcgaattggtgtttcgttaaccgagaatggtgccatgtatcctacggcttcggttagtgggatttatattgcccatccctcttctcaatatttcatgatcggttctatcgatgaggagcagatgagagattatgcgagccgccggaatttaacggaggagcaagtccgaaagttattgagtaggaatataggataatttagtagcatcactgcaacccgggttgcagtgatgctgcaatgcctgtgcagtaatactgcaacacctattgcagtaacactgcataggcattgcagtaaaaaatcgatcaatacgatctatctgccatagtaatgcttggcggaaggaaccatgataacgttcaattccggatcagccatgtctggatcgatcgggaacatcggtctcacgatattcttatagggaagcttcttgaagtcctgatccacgcctccccttgtaaaagccatcacccaatccgcttgtatattgtaccattgggttacaaggtaaccctgtttaaccattacgatatccatttccttcgggtcaattcctgaaccctctaggtttggagtgggagacgatgtgcctactaccacataaacgcttccggtctttacgatagcgatatctcttttccgtctccatgattccgcgttcttgtcttcttccggactgacataaaccacggtacccgacaatttcacgggaccttcgtaggaattatcgaccatggcacctaccatgccttctacgtgtccgcctacgccgaccttacgtgcctgcttaaccacttcttctcccgggatggagcaataaagaacgctctttcccttatcagtctggaattccggacgcttcaagagtctcgccaaagtccaagtgacctcgcctgagccgcctccgccgggattatctcccatatcactgataaagaaaggcttctttttgcttgctattgccaaatcgatacatttctcgagcgaatatcccggagcttccagcgagaactgcttacggacatcccagaatttctgggcgagtttcttcgccccggcttttacctgttcctcatcgtcaccgtaaaccatcacggttccttggttccgtgggttgtctccccaaacataaccgatccagatccctgcgtctatcactccgggcatggcttcaacctcgggaaccaatgcgtacagcgatttcgcaggctcgacacgggtactcgaccattcgccggaaactaggacaggaacagcaacccatgccttgtatgccggacgtcctttccccgactcaagacgttccaacaaattgacgacccctcgccgatgtgattcgcgagaatccgcatgcggtgcttgacgataagtcgtaatcaaatcggagttgagagctaccaaccaagacgtatttccgtgaaggtccatcgtggtggtagtcaagacatcgtttccgatcaagctacgcaccttctccatgaattcgccctcgggatcggctacgccttccacgctacaagctccgtggttataaaaccagaaagcgtcatagggcatattggccttgatcatctccaatgttttttccacaaatgcgtcgtacgattcttttgtcacggggcctcttccaccgccatagccaatctgcgtgggaagccaagtggccgcctgtcccattgcggagtctgggctgagatagtccggcattcttacggggtgtcctacgagcggctgcctattcgggacgaacacgctgttttctatctgtataccggcaataccgatacgaggttttttcttctgtccaaagacctctccaacgaacgatacggccaagagacagattccgagcaatactaaattcctattcatactattatgatttttgcgaattgttatttccttattaattagttattaaaccgtcactaatatcaatctcggtttgaggtataggcaatacttccgcaccggcgctgaaaggagtcttagctccaaattccgccttcttggttccgttaaatactttctcgccccatcctacacgtaccacgtcaaagaaccggaaaccttccattccaaactccagatgacgctcgttcatgatgtcttcaaacaattggcttcctgtatggtttttaggagccaagttgacatggcttcttacctcattcagatacttttgcgcattagcgatatcgccgctgaaatagcaagcctcggcatagttcaaatatacctccgcgaggcggataagcctgaggttcgtgggttgattatttccccgattctcctctctttgcccgggcgcgagatatagtttgcgattgtaccaaccggttcggtcgtccgtaacgggtgccacatcgcctttggccgcggtctcgatctctatggcctcttccgtggaaaggagagtggtcttctttcgtatgatatccccctcggcatcataagcgtctgccaaggcctgtgtaggttgtgcgcaaccgaagccgatcgtcatgtttcggggcatagacatcagcacgtgacggttgccgttattaacgccatacccgctttgggttgtggaggtatacatatttacttcaaggattgaagaagagcagtgctcgccgtccagtgagaattgccaagcgtaatcctccggagcgaccaagctatactcacccccgcactcattctggaatttctcgaatgccttttttacctcatcgtattttttctcatacagataaatacgtgtttgcatggcgatggccgcgcctttggtaatccttcccgcatagcttgactcgtagttagccacctcacttttcttaggtaatacgctaaccgcatcgtttaggtcttgctcgataaccgagtatatctcttcgacagacgcacgtccgagtctctcatgatcgagatccaagactcccgtatagcaaggaacaccaccaaaggttttcacaagctcgaaataagtataggcgcgaataaacttggcctcaccgatcatctgttccctgttatatttcgagaatagggcatcgtctgccatttccatatcccgtataaacaaattggccttattaatacattggtaagaataccgatatttgttcaagatctcggtatgatccgcttgatactgataattctccagcaacgtgaaggtttgtgcgtcgttcgaagaaccgctgtaggtcgcgtcattcgacaacacgtcgccgaaacattgcattgaccatgtgtaacggaagtccttcatgacggaatagacagcggtcagacgcaagaaagcttgtctttcctctgatatctctccagcctccggacttcctaacggagctaaatccaaatctgcacaactgctgaatcctgttaaaatcgctagtacgattcctatgatatatttgtttttaaacatgacattataaattttaaaaagtaacattaatacctccggtgaatgaaatgttctgaggatagataccgtaatctatgcctctagacaaagagctggactgacccacttccggatccatacccgagtaactggatatcgtaaacaagttctggccgcttacataaaaacgtactttttgtagttttatcctctgcgtgagagaagcgggcagggtataacctagctgggcgtttctcaagcggaaataagtcccgttttctacgtacatgtccgagaagcggtcattgtcgtttacgtccgtagccgtcaggcgagggatgtccgtatttgtattatttggcgtccaatagttcattaacgctctatccttgttcgttatatcgttcgggaagtaggtgtaataacgcatcgcgttgaatatctgattaccgattgttccaccaaactgcaaattgaggtcgaagcctttccacgccatacccatgttgataccgtatatgatatccggaataggattaccgatcatgcatctatcacttgagtctaacttgccatcgccattcgtatctacgaacaatacatcgcccaattcggcattaggttggaaatccgcccgcttaacggcattcaactgttcctgtgtttggataagcccgtctgtcttatagccccagaacgcgccgataggcataccttcattcgtataggtgaggtacatgcttccgtttcggaatggtccatcggagattggtgtgccaccattcaatttcgtcatgcggttacggatggtcgacatatttactcccacgttgtattcgaaaccgctttcggtcttgtctctccactcgagattcatctcgataccgcggttgttcgcctcgccgatattggtgtaggtgttgctggcatatcccatatagataggcataggagcggccagcagcatgtccttcgttgtcttgtaataatactcgaagctgaagaccatgcgggtgttaaagaagcttgcgtcaagaccgatattcagagattccgtggtctcccatttaatatccggattgcccaatctgctcacggcaataccttgatacaaggtctcattctctctcgctccgaataaagcaccgtattgcgtactcaatgacagcaaactacgatccacataattggtgatattctgatttccgatctgtccccaacccccgcggagtttcaaggaggaaacccattcggcgttcaatttctggaagaacggttcgttgtcgattctccaacctagagcgaacgaggggaagttaccccagcgattcttggaagagaatttagaggagccgtctcgccggaaagtggctgtaataaggtatttgttattgtaatcgtagtgtaggcggcccagataagacatcaaaccatattccgtagcgctattgctggccgtggtcttgttcttgtccagcgtagcgtctatataatgcaggttatccgactctccgataagatctctcgcatttacgctcaaggtttcctgcttaccccattcattggtataacctacgagagcggatatggagtgcttctcggcaaacgttttctcatacgaaagggtattctcgaacgtatagtaatgccctttggtctgcgacttcgataaactactctctaaatttctttggcttgaggatacctcatagacaggcgagaaggttttattgtctacccttctgatttccgctccgaagctactcttgaacttcaatccttttataatctgccattccccatacatattgccgatgaaagcaagtttctcccgttgattatcccgatacatgatacttgccaatgggttatagtagtcaatataaggagagtaaccatatgaaccgtctgcgttttgggcgggagttaccggatccaaacggattgcgttacttacgacaccatagtcggagtcgtacacattactactgttgcgctcgctaatacttgcgtcggtagatcttgcgatcgacgcgttggtacccactaccaaatgatctttgagcaccgttttttccgtgctttgacggacactgaaccgttcgtagttggatttcttgatcgttccatcttggttgatatagttcaagcccagattgaatttatagtcgttctctttaccaccgcttatgccgacactgtagttatgcataaaggccgtatgcgtaatctcgtccatccaattggtggaaacattacgattgacaagggccaagttgatgggaacgctcctcactgtgttcaactgttcttgatagtcgtaccattccggacctgacatcaaatcgagattattcaatattttgttcataccccaatatgcgtcgagcgtaacggtggtttttccagcggcgccttttttcgtagtgataaggattacgccgttcgcgccacgggaaccgtagatagcggaagcggaagcgtctttaagcacctccatagactgtatatccgatgtgttcaggtagtttatatccgtcacgggcatcccatccacgacgaacaatggctccgcgtcgtttaccgtaccgacacctctgatacggatcgtggcggcggaacccggagatccggaactggaagtgacggatacaccggtagccaagccttgcaatgcggtagaaacattggccactgcttggcgagcgattttctcctcgctcacggacgagatagcccccgtgatatcacttttcttcatcgtaccgtaaccaatcactaccacctcatccaacttttgtgtgtcctcttgcaaggagatgcttaaaaccgatttattgcctaccgaaatctcctggttcatataaccgatataggacacttgcaaaatagcgtctttggctacttccaacgtgaattttccatctatatccgttattgtcccgtttgttgtcccttttaccatcacattggcgccaattatcggcataccggtagcatcaatcacggttccggtgatctgacgggtgttttgttgcggggtggatacgattgatggtttctctataatcttgatgtcgcttttaatgcgcatgtttggggagtgtacggaagcgtatacccctgtggtaaaaataaatagcgggattgaggttaatttcatgactctgcccaatttagtttttgtgtttaatcggggtttaggattccccttataattttcattcatacatttgtaatgttttagtgttagtattatttgatttaaaggcgcttagaaacttgtttggctgggttatgttgccatatcttccagccagtttccctgttagatatggttcatgatggttcctgtttcataggctctcctttctttaagattaactttagtaaactaaatatgtttatttggttgtttgatttgcaatattcgtgaaaaaaacgacacctgcaagcaagtctctgctaatttaatattgtgtattcaatcgatagaagtcattaatacggcttaattatgtcaatttgtcatttctctctccttctgcttcttgtatttgagataggatagggtgtgtgtgtattatatgcgattctctggtagttaagccctgacgaatagaatgtgtatgaaggaaaatacttgcagtttgccttctttttatcaatatccgccgaattattatatctcttgtttcagaaaactaataaatgcctcctgaatgatatttgaaaatcagtcgacttttttgccgttctagagcgcaaaggctctatatagtctcgtttttcagtgtacaaaagattgagattaggagtagaccccagctaaattagagcaagtgccggataatccgaactagatgccgggtagatgtcggttatctgccgggaaatagaaattataagccgactagatacatacaagttcaggatatatcctaaaaaatgtgctattttgggtactaaagttccataatattggtttaaacgtaactgttttgaaaaagtatgtgtttaaaatatgtttagaaagtaaacattatgatagtgtttcggtaattctttttgcattcagatagtatgagttacatttgtcaattcatttcaaatattatttaaaaacagagagatatggatgagaaaggattcgtggaaggggtgagaaggtatatgtcccagttacgagaggaaaagcgttattcctccgccaaaagttatcaggatgcgttgaactcctttataaagtatagtggaacagagaacatttcctattcggatatcaataaggccaatcttcaccgatatgaggcttatttgttggagaaaggctgcatgtgcaacacggtttccacttatatgcgtcgtatccgttgcgtctataacaaggcgatcgaagatggtgatgcggaatatatccccggtttgttccaaggagtttttacgggagtggagagtaagcgcaagaaatccctatccttagagaaccaacataagttgatgacggtgaaggtagagagtgaggtgctaagggagacacaactggtcgtttgtttgttgtttcagtatgcaggaatgtcgttcgtggacttcgcccacctaaaagaaaggaatatcaaaaacgggatattggactataatcggcagaagacaggcacaccgatgagactggaaatcttggatacggcagaattgatgcgcaaggaattaatgggtgacaagaagccggcctcaggctatttattcccttttttgagtggaacgaagacgggctatgaggcatatctcgaatacaatgcggccctatcccgattcaatcgaaatttgaaggcgttgaaaaaggccgctggaatagcatcggatgttacttcttatacgatccgccattcctttgccatggcattgaaagagcaaaatgtccctatagaaatgatcagtgaattattggggcataagtctatcaagaccacccagatttatctgagaagtttctctttagaaaaaatgacagaggtgaatagcacttgctttggttgtgtctataattatgtgtcgaaagtgggatgaggctacttagtgagtagcgtttgtttcacgccgcaaatgtagtaaaaaataacaagttaaataaagaaaagagctatctcgttcgtgagaatataggtagctcactatttattggtggtagacttgtgccaatcggcgatagcttgcctacggaatttctttttgaaattctcgcctgttttgtatgtcctaggtgatataaaatggaaggtgtggcaaattgatattatcgatatttgccacacctccccttatcacttacgaaaactattcttctttttaccggctcatcaagaaagatttgaatccctcgaaatcttttgccagctcgatgctttgcttggttccttccatgaaggctttcagtttcgccgggatctcgatatctgcctccaatatcttatcgaccgttcctttgaatttggcgggatgggcggtctcgaggaatagacccgtctcggtctcgcttagatcgctgtcaagtaatccttggtagccacaggctccgtgcgggtcaaggatatatcccgtctctttatagacggctcgcatcgtagaggcgatttcctcgtccgtatagcgatgtccggagatcagtgcgcatatttctttatgaggatcattgaatgcgccgaataggtcgatgatacgggcgaaattactcggatcgcctacatccatggcgttcgctagggtggcgactgatgggcggggtgtataagttcctgtattcaggtattccaagaatacgtcgttacggttgtttgccgctacgaaacgcttgatagggagccccatccaataggcgaacaatccggcggtgatgtttccgaaattaccgctcggcacgcaaacgaccagctcgtccgcttttcccagcttgtccagctgagcgtaagcgttgaaatagtagaacgattggggcaagaaacgggctacgttgatggagttcgccgaggtcagtttcatatgacggtttaattcctcgtccataaaggcggatttaaccagcgcttggcaatcgtcgaacgtgccgtctatctccaatgccgtgatgttctgtcctaatgtcgtgaactggcattcctgtatcgggctgacctttcccttgggataaagcacatacacgtgaatgcccggaacgcctaggaatccgttggcgacggcgcttcccgtatcgccggaagtagctaccaatacgtttacttgtttcaatccctctttctttatgaaataaccgagtagacgagccatgaagcgccctcctacatccttaaaggccaatgtaggcccgtgaaataactctaagctatagatattatcctttacgggtaccaccggggtctcgaaggagagcgtatcttttacgataccgtccaataccttcggctcgatgtcttccccgaagaacatctgagctaccgtgcaggcgatctcgtggaaggactggttcttcatgttggctatcacctcctcgtccaaggagtcgatatactcgggcatatataatcccttatcgccggccagaccttttacgacggcctcttctaggctggctacaggggcttgtttgtttgtgctgtaatatttcatgctctaatcgtttagaaattcttttataaattgatctttttccagtatgccatatttgccgtttgatacggagaactcatcaaatgtggtaacggagtcgggttgctcgcccggcttgtaaatcaggaatggaaccggggtattcgtatgcgtacgtatggagcaaggagtggggtggtccggaaggatagcgattgctaccggctcgtcccatttttgcgtttcctcgtagatgatacgtacggcacggttgtccagatactctatcgtcttgatctttaggtctacgtctccttcatgcccggcctcgtcgcttgcctcgatatgcaggtagacgaagtcgtttgtcttgagggcctcaagggcggcgtgcgcttttccctcgtagttcgtgtcgtataatccggtagctccctctacgtgaagcacctcgaggccggcgtaaacgccgattccccggatgagatcgacggcggagatcacggaacctttcccgaagccatacatctcccgcatcgttcgcatggccggacggtagcccggagaccaaggccagatactgttcgccggatctttccccgctgccatacgtttgaggttcaccgggtgatcctttaagatctcttgggacttgaggattaattcgtttaataaatcggcggtctctcgtgcttccggaacttccggttttatcattaaaggccggaaaggatggaggggtacgtcgtgtggtggcgtgcaatccagacgcttatcgcctcctttgattaccaataggtggcggtaggagacacccgtatagaacttgacacggtcggagcctaatcgctcgttcaggcattggatcaactcgtccgcttcctccgtggagatatggccggaagagtgattcttcaagatgtcgccttctacgcagattaagttacaacgcatcgccatctcgccgggttgcagggcgacgcctatactggcggcttccaatacaccccgtccctcgtatacggagggcaggtcatagcctaataccgccatgttcgcgacctcgctaccgggatggaaaccatccgctacggttttcatctgcccggttactcccagttccgccaatttatccatataaggagtcttggcgtattgcatcggggtcttgcctcccagagcctctatcggctcgtcggccattccatcgcctaaaatgataatgtgcttcatacctatcgaatattagcaatggatatgatgtcggcgaatacgcctgcggctgtcacgtcggctccggcaccatatcccttgatgatcattggatattcatgatatctctcggtggagatcatgataatattgttgctgccctccagttcatagaacggatggtggctgtctacggcttgtaggcctacctcgcaagcgccgttctccatcttcgccacgaaacggaagcgtttgccttccgcttccagtagctggcgtttctcctcgaaaccggcatctgtatccttgatattcttccagaagtcctcaagggaaccctcgaagtacttttccgggatgaacaggttccgttttacgtcggcttgctccaccggataaccggcctcacgggccaagataaccagcttacggattacgtctttgccgctaaggtcgatacgtgggtccggctcggcgtatccggcttcctttgccatatggatcgcctcgctgaaagggatatcggcgctgatcgtattaaagatataattcagcgtaccggaaagtacggcctccagtttcaatatatggtcgccgctattgatcaagtcgttcatcgtattgatgatcgggaggccggcgcctacgttcgtctcgaacaagaacttgatgtctcggtggcgggcggtctccttgagcttggtataattatcgtaggaggaggaggccgcttctttattagccgccacgacggatacgttattgttcatcaacgtctcgtaaagagccgccacgtccgggcttgccgtgcaatccacgaatacggagttgaagatattcatctttacgatctcttcgcacagatgctccgggttgctctcttccccgttctccttcagctcctccagataattgtcgaggttgatcccttcccggcataaaagggctttcttggagtttgagatacctacaacattcagcttcaaaccgttttgccgcatcagtttcggttgctggatgcgtatctgttccaataaattgccgcctacggttcctacaccggcgatgaaaaggttcaataccttatattcggataggaaaaaagagtcatgaatggagttcaacgccttgcgaaggtatttatgcttgataacgaaagagatattcgtctcggaagcgccttgggcgcaagcgatcacgctgatgcccgcacgtcccagcgtaccgaacagcttcccggcgatacccggggtacgtttcatgttctcgcctacaatagcgacggtagccagatccttctccgctacggtatcgttcatatcaccctgcgcacgttccaaggcgaactcgtcgttcaatacttgtacggccaaatcagcgtcggcgttacgtacggcgaaagtcgtattattctcggagctggcctgcgataccataaatacgctgatgccattcttggcgagcgtcttaaagatccggtagttcacgccgatcacgcccaccatacctaaaccttgtaccgtgatcaaacaggtatcgttgatggaggagatacccttgatgatggccttgccttcctctttcacccgctctttcgagatataggttccgggagcggtcgggttgaaggtattcaagatacggatcgggatattcttatgataaaccggatagatcgtcggcggatagattactttcgccccgaagttacacaactccatcgcctccgtgaaagtaagccggtcgattacgtaggcggagctgatcacacggggatcggcggtcatgaaaccatccacgtccgtccagatctccaaggtgttagcatctaaggcggtcgccaagatggaggcggtataatccgatccccctcgtccgaggttcgtaacctctccggtttccgtgctggaagatatgaatccgggcaccaaggaaaccttgggcagcggcgagaaggtctcttttatgagcttgttggtcaagtcgaaatccacgatatgcttgttgaattgcttgactgtcttgatatatttgcgtgagtcgaacaacttagcgtccttgatcacgttcgagacgatcaaggaagataggcgctcgccataacttacgatcgtatcggatgtcttggcggataaatcgttaatcaaataaacacctttgaaaatattgctcaattcatccagtaaagccatcactttcttctggacatctatgcgtgtgtttttcatggtattagatttaaggttaacaattgagattggctgtccgtgacggatagcctttttttgtatagaggcatgaatacacgaatttttgagaacactgcttaagcgcccctttccgagggtaacatccatactttcaaagtaagctaatttcatcggcaaagtaagttaacttgctttggtatttcagctaacttactttgtcaatgaagctaattgtatttttatgatctttttcggttattctttgtctgtttcgattttgtatacaattgatgtgtttttgtacgcttttagtttagttatgcatttaatagtcaattttttattatataattttgtcttgtgtttttttatgatttccttggttagctgttagcaccaattgatatataaggtttgatggctaatagaagagggggtaaggaaagaaaaatatcaaacgaatatacttgggaccttaacggacagaacaaaatataatattattctgttgattgttgttggaggtaagatttcgtattcccttaatttataagagtatatgcaagagaataggtataatacatgtgatcgttttttaggcggattagaaaaagactttattattacggaacagattgaagatagtccattgacttcagagccttcttttttggattacgggataatagcagtatgtaatagaggtagtgcgatcattcatttgcttgaaaataagcatgtatggaataagaatgaattgattttcttatttccgagacagttatgctcaatgcggaacgtgagtgaggacttctcggcgaagtttatcatcataccacatgtactacatggggatgtattaagttccttacgtcattttgatccgggatttcattttttcgtgaaggatcatttttactataatatagaggataataatggtattgagcgttttcaatcattttgcaaattgatagagaatgagcttgagcggtatcggggtaatgggcttctgagggagcggattatatgttacttggggattttttacatggatgtttacgactattatgtgaaagtgcgtaagaaaatccctttcaggactagtttgagaaaagagcaattgatctatgatttctgtagtctcgtggcagagaatttcaagaatcacaagaatgtcggattttatgcggataaattgaatataacgacaacttatttaagtgcgatcatgaatgaaaggtgtggcatttcagccaaggagtttttatctatctatatagtgttagaggtaaagtcgttgctacgtgactctcgattaaatatacaggagatcgctatattgactaattttccgtctcaatcgacattgaatcgcttttttcgtcaacggacgggaatgactctttctcaatatcgaaaacatatattttcaacatgattatgtttgattttcatattatttctataactttaaacttctgctgcaatcgttattatcgttcatttgttgtataaataacagaggagattgcttgattgatttaaagttgggaattagtggttataatttaatatgacgatgggaaaatgtaataaaatgctagaggaaatgagctttaatgccctattccagaaattacctgttggaattgaagtttatgacgggagggggcagctagtggatctcaataggacggacgagaatttgttcgctataagccggaaggatattatgggaataaatcttttcgagaatcctaattttccagaggacaagatcgctcgtctgaaacagggagaaatggttgtgttcgattgtaattatgaatttgataatatacaaacgaatgagtactataacatagacccaaaaaaggaaggtacaaatttacgtctgtctattaaatgtgtgccgttgaaaggagaggctgaagatatctgtggatatgtactaatgtttacggatgagacggaagaatatcaaaagtcggagaaagtagaggaactgttcacgaagttgaaaacggttatgcgttgcagtgattccttgctgtgggaatatgatgttaaaaccgataagatgcatatcgatctggacttacgtgttttaggtaataaatccagattgagagcaagtaacttgacaacgaaaaaagatttttgtgagatcgtacatccggaagatcgggaaagggtacttgtacaaggctttgaaaagattgttacgggtgagatcggtgaatatagtattcaataccgacagctttttgaggggcaatatgtttgggtgagagcgtatgcgtacccttataaatatgatgaggcgggaagaccagcgaaaatcctttattacttgatggacataacggatgagatcgccatgcaagataaattgcgctgggtggaacgagagcgtcaacggaaagaatatgagttagctaaggctaaagaggcgaatcggcttaagtctatgttcttggcgaatatgagtcatgagatccgtacgcctttaaatgctattgttggtttcgcgaatatactggcagagaccaaggagatagaggaggaggaacgagagttttatgtggatatcattgacaagaatagtgaattgcttctgcaattgattgaggatatccttgatttctcaaagattgaggcgggaacctttgacattacgaagagaaattttgattttaaggagatctgtgaggaaacctatgcggtacatgccttgaagattccgaaaaacgttcgatttgttttcgatcggggctcacaacccgtgactgttttctcagatccgaaacgagtcgtacaggttatttctaatttcttgacaaatgcgattaagtttacttcggaaggtgagatcaaattagcctataaggtatcgaatgatgaaatacgagtttcggtctcggatacgggaatgggaatctcggaggaagattgtagaactatattcgatcgttttgttaagttgaacgcttgcaaacaaggtaccggattaggattggcgatttgcaaaaatattatcgagaacctagggggacgaatcggggtagaatctacattgggagtaggttccactttttggtttaccttgcctttgaaggagattaaagagaatgaacctaagttctaaggggatatatattattttacggatatgttttaaagcatggttttgttaaatctggttaagaaaatgagatttgcaaataaaacattatgctacataacataaaacctctatatttgcactgtgtttttcatggtattagtgtgtttttcatggtattagatttaaggttaacaattgagattggctgtccgtgatggatagccttttttgtttcaaaaaatcataaccatgagattttaggagtgtagctgaaggttttttcgtaaatctggaaagctattgtttgtgccttatacaaaggactttgggagaattacccgattttgaggtaatgatttggcaactgtgccatttacaacgttttgccttgatttgcttctcaagtaactcatttctgccgacaaaaataataaatcttattgttttttcaatcatgtcataagaaaaatagaaaacagaagatgatttactcgtattatcgtttctacttagttcaaatgttttccacaaagcatctatgttagtttccaatgtaaatctgctccccaaactttatatgttatatcttttatctctcttgtttcttgtttccaatgtttagattcttgagatttttgttttatatactctctgtgtacttcatcagatatcaatatagggctatactcgtatttctctgttattctcttaaatgaagaaatgttacggatatgaatatttaaaccattgacaggagaataatctaattcacgtgcaagctgctccgcagttagttttctactatctttaaaccaaccattgcgtggtttgcacaaaaatgacggaattcctaacgggtcgtaataatagaaatccccagttacattataaaattcatcttcaactgtttttccagcaaagtcagtaagccgcgaagcaaggttcgctggtttaccaacccataccaatcccttgttttctgtattctcgttccctttgcgttcaataccgacctttattactcgcatttctccataatcaacacctataccacaatgaaaatcaacagaggtaaatatctcattaattatttgggaaatgtgattaattgtaatagcacaatttactgcattaacaaaacagttactaacaggaaacactaccataactctgtctcctatgatgtttctcacatatccatcatgttctcttgcagcattcagtactccctttgtgaatgcagtataaattcggcccattgtttctgtatcatgttcacgggttaattctactgaatttcgaatatcaacagataaaacacaggtttcaatacacttgccttttttagcatctccactttcatatgttaaatcgcaatcagataaggaaggtactttcgaagatgtattatacgtaaaaccttttgtatgaacatcatctatcatattcctcacatctgttataaaatcttttaatcccatacattatagagttataagttgaataaatgaaatcaaaacaagcaaaaataggaaggaacaaaaacacctcactgattttttatggtatttgaatttgttattacaaatggacgaattgatatatacttgcgaatacaaatcgtttaacattgattcttcggactgatttgcaatatcatttttaaatacattaaaacttctgttagatatagtggtgaaatgcaacagtgatttttcagtcaatccgggctgcttaaacaaattagtgtctattgttccttttataacttgaagcgagtaaaaaatagagaggaaaataaggataaacattgctgccagtataaatagttgaacggtgttgattattgaaaatacaccatttcctgtttcataataattgtatattggcatgattagttgttggtgtataaaactaatgtaatcagaggtacacaaaatagtaagtacaacaccttcaatagccaataaaatactagatttctggtcgcaattattaatccaaccatttactctatccaatctcaaggttaattcatcttttgttattcccataatttccaattttagagcaaaggtactacaaaaaacaacaactactgtaagtgaatggaataaagtgaaacaaaacggacgagctaattaattaacccgtccgttgattgttaatttcttatctgctcgaatagtgtgaactatgagagcgatgagaactgtgtgaactatgcgagctatggctgctatgagaactgtggctggcgagtagtttaaactcggcagaggactgttccaacaccaatgattgttcctgctgctgttcgatttgagtgtcgctattggttaccttagcgacaatcttttcactaacagaggagcaatagcttgcacctgcaaggattgcagagaccgcaaagaacaagagtttcttcattgatacctcctttttttaattaaacattcagttacctaacacgatatatcggatgatatatgttctattttcttgatgtgcgtactatgagcctgtctattagactcaaagaatcccgcacattgccctttcaacacacaaccatcgcattcggggatatatatgtctttccaatccgaaatagattgctgagcatagcaacgaatatcttcgggtaatacacataattgcgcattataaatatagggtttcattcctctatctgcaagcagtaaaaccgcttcacgcaattccctattgtaatcatacgggtctatccatagttcttcaaaattttctttcgccaagccagttgtttccatttgcataaaagcgacttggacgacaaaagggaaattgtgatagatgaaatccgcaaattgaggaagtcgtttgtaagtttgcttatgaacgactatacgtaatcctatacgctgacggaataatgctaaattatatagtccttgaactgtcttgtagaatgttttagctcctacaatacggttgtgctcgtccgcaatatccgagaataaaggtatatctatttgcaaatcctgatgtctgcatttagctaacttcattgcgtattctttgtccgcaaactttacaccattagacagaatgctgattgctgtatgaggtaattctttcttgatatagtttaccagcgtaaagagattatccccaataagagttggttctcctcctgttatacctatttcctgtgtttttttgtcaaataaggaaataagtttcaaattgaacggggtcttatctttttcctgcaaaataggaggttgcggacacataatgcaacggtggttacaacgctctgtagccattaaagcattgtgattggagagtatttcatacacgaatataatttctccttgcttattgataacaaccacatctccttcttggaaagttccgacattctcaactacacaatacggtttccctttacttacaaacgatgttgtttccgtaatggtagccaaatatccgatagagggtttacttgcatctttgcataccaatatatcgttggaacgaccaaacaagttattcttgccaaaagttatacgtccaactatatcatcttcgatgttatatgaagttccttgaatctgtttcatcgttcaatcaatttaaccaagaccaaaatattctgtttatctcagggtcgtgcttctgcaacaactcaaacaagtagtgtataatggcttttgttttcttacacatttcgtttgttggtcggaaacctaccatatcgccttgctctgacatattacgtaccggatctgcaccgcaataaggttgaaatacacattctgcacagacaggcaagcattcgttacaagcagaagcaatgatatgatgaagtaattccccattaaacatttcttgatagctgttttcgtttacattgcccaatctaaaatagtagtttttgaaacgtgccatcatacgagcttcatcagaaacatacacatttccgtcatagtcgtagattgctccagctatacccactccagcaggtgactgcaaatccacaaaaccggtagcaaacggcgtcagcattcgtttcaacaacaatgcagcaaaaccctctacaaagaaagttccctgcttatttaattctatgatgtaatccagcccctctttataattggcgataaactcttcaaccggataggctatcttatccttgtatttcttggcaaatccataaggattaagagaacgcaggaatatgttattgaatcccaatcttatatattcatctataatctccttgaaacgtcccaaactatatttggaggtggtcatcaatgcagaaacacactcgttatctccccatatattccttatcatagcaagattcttctcaaaaatggcatgatggtctaaatccttgttttgcaaaggccggttcatgtcgtgcaaatcttttggaccatcaagagaagtggaaatcgtacatttatgtttcttcaagtactttaccatatcttcgttaagtagagtaaggttcgtacagattacaaaatccaattctcttttcttgaataagttttgccattcggcttcttcaatgatatattttaccatatcgaagtctgttgatgggtctccaccttgaaactctattttgatacaaggcgatggagattggaatatggttttcaccacattctttgctgtttttttagacatgtcggcagaatggtcatccatatttttacgggcaacctgacaataaatacagcttgaattacaacgtagtgttggcacaatcatgtgcaacgaagtgaaatcacgcaagatacttttcttcgttctaaacttagtggcaagcatctgcaccacatcttctaccttgtcagttgttgctatttgtttggaagcaaggtcatagaacaatacgctatgttcgtctaacttgccattaacaaaggtatgaaaatcatcatttgacaagaatacatattctcctacttcatttgttagaagatactgattatcattgaatcgttcaaaacggaatggtagtaattgataagccataattcatcattttgttacgggtttgaacgcttcttgaactatcatatcacgaatatggccaaactgaacatttgtattataacgaatctgttggtctatcaattcattgcaaaactgtttcggaatcacctcagttaccttgctgttatcttttgattcaaagataacatttacaagtgtttgattacaagtgtccatctgttgatgaatatagaataaatgggataatttatagatagctgctgttattacttctttagcatacaggcttgtatctattgaaacttgaaacttatcttctacaagttccacaatgggaattttaatatctgccatagtcgtacatctgtgtctttggcagtcctcaaagacctttatttatgcacgaagcgtgaactgcaatgcaactatgtctttaatggaggtcctgagaaaacctttacgaacagatatagtaatagcagcccacgctatagcgtgagaaccactatgctatccttgttcgtaattagaaatttctcaggtttccattaacaagataagcataacgcttcttctttttccaatatgtcttggaaagagtcacctcaatccactgcaaaagtacaaaaaatccgtgatgtaacattctactatcacggattttattatgatttacaagttaataccccgattttgtctccttgcttgtggtttcagcttctccataaactcttctttcttccttctaaaccagctgacatgtgaaactccgtcaatgtggaggttgaaattcccctccttgttctctttaagtgaacatatcgttttatctaccctaaaatgttggttgaactcgcgagaatagagctcgcctttgatggaaacatccttgaacgtgcataactttctaatgagggcatcgccaaagttcagcgtatcacgcaggaacttgatggttggcatcagcttctccacatacggaaagtagcatttgacaaaatccacgaactcggacaacttgcggtgtcgctgttcgtaagcatccgttatctcctgtatgtgcttcgcctgttgctgttccctttgtcgtgcttcttcttcaagttcaaggatgcggtcttgcaagtcctcgtttctgcgttccagtgtcctgactttgttactgccgaaaagagaaccgacactttctgcaatgtgagtcgctgctgtggtggctgcgcctttcagtttctcggtctgcacctctttcttggctcgtctgagttcctgctccgcttcggttttcagcttctgcaaatccacgacttccgatttcaaactgccggcaagtttctgtatgtcccgataatactgctgcgtggatttgtggcgagcttgcgagccgtctatgccacgttgcagaccgtactttgccatcgcgacggcataactgtcttgataggatttcagcttcaagcgcgtcatgatgtcatcggcacacaaacggacggcattggctggtttcttgcgatagcgtttctttgcctgttcctcacgtttcttgcgcttgcgctctcccttgacaatcgggacgagggtaacgtgtatgtgtggcgtttcctcgtccctgtgcagatgtgcagccacgatattctccctaccgaacaggtcggcaaagtatttcatattgtcgccacaccattcatcaagtctgccctccctttcgatacgcttcatatcctcgtgcgttcccgacacgttgatacggatagctcgaacttggttgtttccgattttgcgtgtcagtcctgcttcctccaatctcttttgaatggctgccgtgcggtcttttatcccatcggggtatgtgacgagttttcggttaaggtgtgtgcgtgtggggtctgcgttcttcggtatgatgaaacgctcgatgtgagcggtcgtcccgctgtcagaaccgtgcgccttttccatgtgtaatactacgaatcccatatataattcctttttattctgcttgtgaaacatcgtttgattattgcttatgtacggctgttgccgttggtcttggagagtccagagaggtgcaacctctttggcttattggggaattttcagcgttgcttgcaatgcggctcggacaaattccctaataagctacggtattttccatcggtaaatacctgtgccgctgcaagcatccccttacatcttcagccctttcttttttggtggctgtatcatccgccttgcggattggagttgcttcctctccgttatcggtttttccgattggaacacgggcttgccacacaggtaatcgttcaggtctttgtgtccgttgtagttgtcggagaagtcccggatgcgaccgctgaactctcttgccaattccaagtaggcatttcttcctgcctcgtcattgtcaagcaggcagtggatgcgctcgtacctatgcagcacgtctatggctttggaaacattggcaaccgaattgaggatgacgtaatcctgtccgtcaaggttgggcatagtcgggctgttcctcatccgcaacgtgaggaatgacaggtagtccatcataccctcaaacacaaggcacttctccctcggctctccttgctggcagatatggctgatatccttcggtgcaatgcagcccttgaagaaacggttgcgcacttcataccctcctgccacattcgggaagccgatggcgaaatagggcttgacgttatggatgaagtgcagttctttacattccagcctcgccaagtcggtgtttatgcctcgttcctgcaaatagctgagcaatgcaggatgggtaagttcgtccacctccaactgttggaaactcggttcggatgcttgctggcgaaaagagaaagatactggacggatgtgcggtactcgctccgctatcttgttgagcaagtaaggcacatagtcggttgcgtatagttcctctgccaatgcgatgatgttgccgcctttgccaagcccgaaatcataccacctgttaagttcggtgtttaccttgaaggaggcatccttttcctctctcaacggcgatttgtaccaaaggctgttgccttgttgtttctcgggcgtataacccaaactttgcagatagtctgcaatgcgtatgttctttacttcctgtatgttcatatttctatggtttgatgatgaatgtaaaaccgataaattgatgaatgtgtatgccaaactattggatagcaaccttatgcgctctcatcattgtttcatcaaagtacttaccaaaagagaaaatcatcatttgccttatagtgcatggtctgcctgaccctttttctcttttcatcagtaagttgtttttgatgagtgtttgatgagaatacaaacctttatatatcagtatggttatatacttattcatcatttcatcaaaataatcagagtgatgtcaactgttctcttgttacggtatagaaccgtcctatcctccgtatgggagaatagcgacactctcgggtatagtccacttgataggtggtgtaagtaagcgtattcggtgcaggggtgagtttccaacattcctgtaatacctttcggacttggcacttctccacctttacctgcgagtgtaccaacaaaagaagaagatcgttgtaacagaacgagaatgtgtccgtgccgatactatccataatgtcaaggataagttcttgcatctctatctctaatcggttgcggttgctgcggataatcttctgcaaggcttcggtatgcagcaatgagggagcaaaccacatacggctttccttttcggtggatagctgtctgtgttgcaggaaatggagaaaggcgggtatctccgctttcagcttttgcagaaagtcggtgtcatcggactgcaagcggtctatcttgcgtacccaataacgtgtttctcctgcatctatgattacgggcaggtactcgttgttggagcatagcacgaacttggcaaagaacgcaatctcgtcacggtctttgcctttggcttccaccttataggatagggttgtactgaggttctttaacctctcactgtcctccctgcggttgagcagcacctcatccaccacgataaggagctttcctgcccaatcggaattgaactgactgcggaaatcttcgttggtgttgaacgtgacattgttctgaaagagggcttttagaaagttgagaaacgtactcttgcccgtgttgcgttcttccgataccaacagcaggataggcaacttctgaatgggttgcaggtagagcaactgcagatagtccattcctaactcgtattgctccccgaagatgtgccgtaccaatgattggatgtgagagaaatccccttcctttggttggtggtctatcggttcatagaggttaagaaacttaccgaccacggggcggtagccgatgtgttcgggaacggtgcagaaaccgtcatacttgggaacgctgccgatgtagtccttgccatagtcctggcgcagggtctcgttgttccatgcgatacgtttccttacataccctccgttcagtcttggctgctccacaatcttgtagagcgttgttcccactcggatgaactcttcttttgccacgctgccatctgatggcggtttgtggttgtcttgttgtttgttagctgacataatcaaatggttttaagattgaaaaataccagccacaaaagtataagcatttaatggataagttgttacgcaaaatatagcagaatatagaaaaaagcccctcgaaacaaaaactttcaatggtttggctatggaatcggattgaaaagacgaaaaaactcccgaaaagcgaatggtcggatgacgcttttcgggagaaaaaatcagagtatctgtcgtgttgttgtactgacttgcagatttactgactgcattacgtcagtctcacatcccaatctatgagaggtatttggacttggctatatcggcattgttcagcgaaaagaagatggcttgtttctcttttcgcaagtacagccttttcataattgcattgcgcatctgcttcgctccgaatgtgctaaagtggaaagcgagggcgattatcgtttcaaggttgtaaaactccatgctgcacttgtcggataggcgtatggtacgctttatctcgtactccctcaatacaccattcttgcaaagagcctttatccctgcccgaatggtcaggacgctaacaccgaacaaatccaacagctcggcttcgttcatccatacattggctatatcattcggtaaagtaacattgccgaactcgtctattcttataatgtttctttccatagtcctatgccattgttgtgtttccaaaagattggttcagtttgtcaccgaacatcgtaaggtcgtggtctatcttctgcgttgttatcttcgcatagagttgggtcgtaacgatgttcgtatgtcccaacacacggctgacactttcaatcggcatacccttactcagtgcgagggtggcgaacccatgccttgcacaatggaatgagatgtcctttgtgattccgcactcttttatcatctttttcaacggcttgcatatagaccaatagttcagattcgggaaaacagacttgttcgtttggaacttttcgtaacgcttgataatctgcaaagggatgtcaagcagtttcacttggaacgggactttggtcttgtgccgcttggataatatccacttctcaccgttcacctccactatatcatcagtggtaagttccttgacatccacgaatgacagtgcggtaaagctggcaaaaacaaagatgtcacggatgtaggaaagtttggcatccgcaaattcgtgtgtcatcagtgttttcagttcttcttccgtcagatactcacgttcctttatgttgggacttatatggaactgcgcaaatggatttctcggtatcagtccgttgaagtgtgcacgcattacaacccctttcagccacatgcagttagtccagatgctgccgttctgcaatcctctgtcggtggaaaggaatacggcaaactccttgatgaagtcgggagtaagttcaagcatagacaggtcgcttcgcttgtagttcgccctgatgaatgccgctacatggtttcttgcacgaacccttgccatgtaagtcccttttacacggtcagtacctacacgcttttgaaacgtggcgttgtccttgtcaaatgctccgagcaatgtttcatactcgctgccgattccttgataggcattgcgcaccatttctgccgtaacatacgcctctctgtctgaaatgcgctggtagtgcttgatgatttgcgcctttatgttgtctaaagcgtggttgatgtccctcgcctcaatgctcttgcctttggctcggttacccttcgcatcccaaagcgttttcgggatggtctgcttgcaactgaactgcgccacagaaccgttgattgtcactcgccccatgatggggacaataccgtttttctccttgctgccgttcacgtagaacagcactttgaatgtacttcttgccatactcgttttttgtttgcaaagttaaatatcaacgagttaaaccttgctacgcaaaacggtgacaaacggtgaaatagcgtcctacatgtgttaaatcttacatcttcttgggtaatgatttgcaaaccgttctcctgctatattctgctatttcttgcattttccgctttttcggtttgtcctcatctgacaccgtaacgacattggtacaaagtcatttagcgtcatttctccaatttcccgaggttattccagagatttatagtaaatttgcgctccgtttgtaatactagatcctgtatttaagtgtatgaaaagagtattctgtccaaaatgtgataatcagttgtcttttgatgagaccaaatatccggaagggaaggtattagccttcgtctgtccgcagtgtggagcgcaatttaagattaaattgggccgaaaggtggtgaagacggctaccggtgaggaaaaagaggtgaaggaaccggatttctcttgcggttatattaccattatcgagaatggttttgcttttaagcaagatctaccattagtgatgggagataatgtgattggtcgccgtaataaggatacggaaggtgtagatgtccctattatcacgagcgatccaagtatggggcgtaagcattgtgtgattaatgtaaagaaagacactaatggcaagttcgtttatatggtgcgtgactttcctagcttgaccgggacttttgtgaaaaatgtattggtcggtaaaaaagaacaagtacgtatcggggaaggtacgatcgtaacgattggcgctactacttttatcttacattcggcgaacgagggagaagaagaggaataaatataaaaaacttcagaggctgttcccgtttatgatctcgatctttaacttcgggtcggaatgatggcagataagggattttggcgtttgttttgggagtgagttataagatatatgctcattccgggatacagctctgaagtatcactgagaaaacaaggctcataggtattaagattaagccgattaacataaagaaatgaaaagaaccgaaagaatagttgtattaactatggttaaaataggctcttagggtttgtttttctagaaattagctaactttttgtgtggtttttgaaatgttaatgagcacgaggttaaatagaaatatggacagtcatggagcaggtttctaaacaacagccggtaaataaaacagcattccgggtattggtggcgttaagcgttacgcattgtttgaatgattcgttgcaatccgttatctcggcggtttatccacttttcaaggatgatttagcgttgagcttcgcccaaatcgggttgattacgcttgtttatcaattatccgcttctgttttccagcctataaccggtttggtttttgataagcgtcccgtggcttggtcgttacctattggtatgagttttacgttggtcggcttgttgaatctcgctttttcctctacgctccattgggtcttgatctccgtatttttgataggtatcgggtcttcggttttgcatccggaagcgtcccggattacctcgctagcgtcgggagggcgtaggggattggcacaatcgctttttcaagtgggtggtaatttgggcggatcgttaggtccgctactggttgctttattggtggcgccttatggacggactcatatcgctttgttttctatactggcattcgtcgctattttggtgatgattcctatctgccgttggtataaggcgtatttgagtcgggtgaaatggcagaagaagtcgggtgagacgcatgtggagatgcctctttctttgggaaaaacagtcttttcgatctcgatattgctgaccttgattttctctaaatatatctatatggctagtttgaatagctactataccttttacttgatccataaatttggggtgagtgtacagacttcgcagatctgtttgttcgtcttcctgatcgctacggccatgggaactttggcgggtggtcctatcggtgataagataggacggaaatatgtgatttggggatcgattctaggggcagccccatttagcttgttgatgccgcatgtgggattcgtttggacgatcgtgcttagtttttgcgtggggttggtcttatcatcggcgttcccggctattttgttgtatgcgcaagagttgcttccttataaattaggtcttatctcgggacttttctttggatttgctttcggtgtggcgggtatagcctcggccgtattaggaaatatggcggatcattatggaatagaggctgtctacaacgtatgtggcttcatgcctcttttaggactggttacttggttccttcccaacttgaaaaagaagtaaaaacaatcctccctttttcgctgttattactccaactgaacgtcaattactaaatgagtttatggtgagtaatatagtatcttacagtattcttttgctgtatcttcttccatgcgcttcatggagccaagggaacgatgtggatttaagcttggaacaatctctcgacctgcttcataaggaaaataaaagcttgaaaatagccgggaaagaagtggaatgggctcggaatgagcatcaaaagctaaacgctttttggtatccgtcggtgaacgccgcgggtgctttcgtacatatgtcgaatccgatagaggtacggcagtcgctgagtaaatatacggaaccggcgaaggagtttgtccataattatatcccggataatgagttgatcatgtcggtattggataagatcgggcaaggtactttctcgcttccgctgatctcccaaaacatcacttctatagacgctacggtgacgtggcctgttttcacgggaggaaaacgtatctacgcgaacaagatcggaaagacgatggtctctatagcggaggtgaataggagccaagtggatgctaaccaacaatccttattgatcgaggcttatttcgggcttcgtctgggacaaagcgtggtggacgtaaaaacagaagtgtacaattctttgaaaacccattatgaccaagcccttaaattagagcaaaacgggatgatcaatcgggccgagcgtctgttcgctcaggtgagtatggacgaggcgaaacgagaactggaatcggcccgtaaggatttagcggtcgctcaacaggcgtttaaaagcttgattaatatggaggaggggagcgacgtacgtaccacgactcctttatttattaatgaggcgcttcctccggcccaatacttcaaggatctggttccgatgaataattatatagtcaatcaattgaaattgcagcaggttgtagccgataatcaactaaagatcggccggtccgcttatgtcccgaatatcgctttattcggcaaacagactttgtacgctgacggattggataaatatttgctgcctcgtacgatggtaggagttggttttacgtggaatatctttgatggcttgaaccgggagaaaaccatccggcaggcaaagatcgctagtcagtcgcttcgtttgggtaaggagaaggcgattacggatctggaggtcggtatcgataaattctacagccagctacaaaatgccttggacaatgtaaaagctttggatacgacgatcgagatgagccgggaactggtccgggtgcggaagaaatctttccaagagggaatggctacttctacggaggtagtcgatgctgaggttatgctggcgaaggtgaagaccgcttttcttttggcttattatcagtatgatgtagccttgattaatctgctgtctgtctgcggtacgccggagcagttccaccaatacaagatggagggaaagaccgaggagcttttggggaattgaaaattgagaattgaaaattgaaaatttaggggttatggataaaactaagagatatttgagtgtggccttcgtcgcagtcttggcgattgttatagttgtctcgttgatcgggatgatcttgttgaaaaagaagccggtgatcttgcaagggcagatcgaggcaacggaaatacgtatctccggtaagttaccggggcgtatcgatacctttctggtaaaagagggacagaatgtacgccaaggcgataccttggtagtcatcaatagtccggaggcgttggctaaatatcaacaggtgaacgccatggagaacatcgcgaagtatcagcaccagaaagtggatgagggtacacgaaagcaaatcatcgcttccttgcaacaattgtggaataaatccaaatcggatttacaattggcgaagattacctatgatcgggtgaatgccttgtataaagatagcgtggtaacctcacagcgtaaagatgaggtggaggccatgtataaagcggccgaagccgccgaacgtgccacttatagccaatatcaaatggcggtagacggggcgcagatacaagataaggagagcgcccgctcgttggtgacggcggcacaaggaaccgtggaggaggtggcggctctcttacaggacgctcggttgacggctccggaatcgggacaaatctccgctatcttcccgaaacggggagagttggttggggccgggatgccaatcatgaacttagtcgtattagatgacgtgcatgtggtattgaacgtacgtgaggatcgtttgcctttatttaagatgggaggaacgtttgtcgccgatgtaccggcgatcgataagaaggatattgagttcaagatcaattatatcagtccgttgggcagtttcgctacttggaaatctaccaagcagactggtagctatgacttgcggaccttcgagatacatgccttaccggtggagaaggtggagggattgcgtcccggtatgtccgtactctatcaactcccttaatactatccatttgtagagacggggcacgcccccgtctctacaactaaataatttattgtcgctatgctaaagaagagtcctttctatatggttttacgtcgggaactggatcgcatggtttcccggaggttatacttcggggtgtgtatcgtgctgcctctgttctgtatattcttcatgtctacgattttcggaagcgggcagatggagaatataccgatagcggtagtggaccaagacaacacctccatgtcccgggagatcatccggcaggtagaggcggtaccgactttccgggtaacccggcattatacggaccaagagaccgctcgccatgctacccaagcaaaagaaatctacggttatctagtgatccccaatcagtttgaggcggatgccacggcggggcgtgacgctactttatcgtattattaccactatgccttgttgagcgtgggcggtgaggtacgtggggccttcgagaccctgctgcgtacgctttccctcgccccggtggttgtgcaagctacggcgatggggctgggggagaatcagataaccaccttcctattaccggtacgatccagtagccacccgctgttcaacccggatctggattattccgtttatctgagcaatccttttttctttgtctttttccaagtgatcattttgctggttacggtgtacgctatcggtagcgagatcaagttccggacaggcgatgagtggctggaggcggcacggatgaacatgttcgtggcggtggtgggcaaactgctcccttatacgattatcttttgtatcatgagcgtcttcgctaactatatcatgttcggggtcatgcatattcctttcgcttgcggtttctggccattgaacttgacggcgatcttattcgtggtcgctacgcaagcgttggcggtattcctgttctcgttgtttcccgctatagcgatcgtgattagtgtggtgtcgatggtcggttcgctgggggctactttatgcggcgttactttcccggtcgattccatgtacgctcccgtacattacgcctcgtacctgtttccagtacggcatttcgtggagatcaaccagaacttattgtatggcgattacggattcccttatacatgggtaaacgtaagttcgttgtttgcgtttatgttattggcattggtgctgttgccacatttgaaaaccgctattttaagtcataaatatgagaacatccgataatatgaaaggaaccttggcggatatcgcttccttggtcaaggacgagtttaagacgatctccacgagctacgctatcttgctcgtcttggtaggaggtatatttctctatggcctgctgtataattatatgtatgccccggatctggtgcgtaacgccccggtggtagtcgtcgatgactcaaagaccgacttgagccgggagtacatccgtttgctgaacgccactccgcaagtctcggtaatcgccgatggtttggattacgccgaggcgcaggagtggatgaaggagggggatgccgtaggtatcttgtatcttccctctgatttcgagacccgggtggcacgagggaatgagtccctgtttatcatgtaccagacgacaagcgctttcctatattatatggcgatgcaggaggcttccagcggtgccatgttggcgttgaacgatcggtatcgtccggagatgttggtgttcttgccccagcaagacgcttccaagatcgtttcggcgcaacccatatcagtggtcgggacggcgttgtataattttacggaaggatatggaacctatttgatcccggcggtattgatcgtcattatgttccagaccttgttgatggtgatcggtatgataagcggggaagagcgggattcgggtaccatcgttcgtttcgcctccgagggattatcctttggccggatcgctagggtgataatcagcaagacctttgtgtattgcgtattgtatacgattttcgctttgttcttgttgggcttgataccgctattgtttggcctgccggatatcggtaattatctgaacaccttgatcctgctgatacccttcctgctggctaccagcttctttgggctggccgcctcttatttctttacggactcggaggctccgttattgatgatcgccttcttctcggtaggcttgatcttcctttccggagtctcttatcccttggaattgatgccttggtattggcaaatggcccattatatcattccggcggctcccgctacgctggcctatgtacagctcaactcgatgggagcgtcgattgagcaagtcggtgtggagtacgtgacgttgtgggtgcaatgtgtcgtttatttcctcttggcttgctgggtgtaccggcggaatatcttaaaggcgagccgtgccttgtcgtcattgtagctcccgtatcctgacgtcgataccgctacctttcaaggcatctttcaactcgccgatcttcgtatccccgtaatggtaagggtataggattttaggcgagaacatcttggccgctttcgccgcttgcgggacggtcatggtataaggctggttgacgggaaggaaagcgatatcgatgtctttcaggtctttcatctccgggatgtcttccgtatcaccggctatatagactcttagtccgtcgaacgtgaggatatagccattatcccggtggcggggatgatatttatcccggccgggcgtggtgttataggcggggacggcctctatcttcatatagctgatggaggtatccgtatcgccgtttttcaggaccttcccttttcccagcttcttttggctgttctcgttggcgatgatttccgtaccgcttttctcgacggcttgtatcgctttcgggtccagatggtcgccatgctcgtgggtgatcaagatgatatcggctttcgggaaagtcgtataatcggcgtattcggagacaggatctacctgtatcgaatgattgtcgtacgtaagcatcaagctgccgtgcttgatgaacgtgatgatcagttcttttccgctcttggtcttgaaagaatccgaggcgaagttactagcggaggctaagctcgccatgaataaactacacataagcatacatgattttagtctcataatctcgcggttttttataagtgtttccgcgaatatactcataatagattaattccctaatttgttcgcctatccggtataaatatttacatttgcgacgtatattctgataacatgaaaacgaaatgagaagaattgttctgttgattacgatttgttgccaagtattttgggtggcggcgcaaaagaaagcgcccaaatggatggataagcaacgaaaggcggtggttaccgtcactacttatggaaaagataaccagaagaaagcgtctggtacgggatttttcattaccgagaccggtgaggcgttgtccggctattccttgtttaaggacgcggcgagggcgaccgtgaccgacgccgacggtaaagaatatccggtaagccgcatcttgggggctgatgaattatatgacgtgatcaagttcaaggtagaggttccgaagaaagctgtgttcttgccgatcgcccgtgagccgatctcgcaaggagttaccgcttatctgatgccttactcgaccggtaagatcacgaagttcggggaaggaccggtctcggaggttagtaagttgaaggagccgttcagctattataaattgtcgatggcgctggagagcgggcaggtaaacgctcctgtattgacggcggacggcgaggtgttcggcttggcgcaggaagacgcgtcggggaagaaagaagattcctacgcggtctcggcgggatacgcgaatagcctgacgatccagtcggcggacgcctttaattccacctatagccggattggtatccggaaggcgtggccgtcggacgtgagccaagcgcaggtttccttatatctgatggcaagctcgcaagacccaaagacgtatctggctaccttgaatgatttcatcgccactttcccggattctcccgacgggtatttgaaccgtgccaatcattacgcttaccaccgtgcggatctggctcctacggaggccgagcagggggcttgtctggataaggcgttggaagatataaacacggcttcccgcttcagcgagcggaaaggggatgtctggttcaaccgagccaagctgatctacggcgtggccgccgcggatacgaccttgaataaggagcagtggaccgtcgatgccgctaccgaggcgatacaaaaagcgatcggggaggaggacttgccggtctatcgccaattggaaggggacatccatttttataaaggagatttcgagcaggcgttcgatgattatatgaaggtgaacgatagcgatatggcatcctctacctcttggtattgggcggcgaaggcgaaggcgaatatccggggcgctaacttcggggatatcatcgccttgctggatagcgccatcgccaaatgcggcaacccgccaacgaacgaggccgctccctatatcttggaacgggtggatctccgcttgaaactgatgcaatacaaggaggccgtggacgattatgatttatactacgatctcttgaaaggacaggtcggcgaccgcttcttctattaccgcgagcaagcgaagttccgcatgaacgatttccccggcgccttggccgatatccaatctgcgatccgcttgaatccgggcgacccgacttatccggcggaggaagcgtccgtatatatccgtatggaaaactatgatcaggcgttgaggagcttagagaatgccttgcggatcgctccggatttcgcctcttgctaccgtctgcgaggcatctgctacgtccgtcagggtaagaaggcggaagcgtgcgaggctttcaacaaggcgaaggagttgggtgatcctgtcgtggacaaattaataaaggaacattgtaagtgacgagatatccgggcaggtacgcacgtccgtatctacccagctgcaggtccgtatctgtccggttgcaggtccgtatctgtctggttgcaggtccgtatctgtctggttgcaggtccgtatctgtccggttgcaggtccgtatctgcacggatgcacgtccgtatctacccggttgcaggtccgtatctaccccgctgcagatacgtatctgcgcggttgcaggaatgtatctgcccggatgtaaggcaccgcttatctccctatgaacttcttgaacgcctctaccttgtcgttcaatatcaattcctccggaaatcgtgtctcttgcaataactcgtagatatgatcgtaccgggctatatcgaaagatatatgcgcgtcgctccctaaaatcacaggaacctcgtatttcttgcataggcgcaagatcgtgaggttattatcccgggcggtgagtttcttgcggaccgggttgagagagctgttgttgatctccagcaacgtgtgatgctctttggacgctaatacgataggctcgaaatccacctcggccgtaccgtctcccgggtggctgatgatgtggacatgcgggttgcggatcgccccgatcatcgcctccgtgttctgctcgaccgttcccggtttgtagcaaagcgagtggatgcccgctatccggatatccagcatagggaagtactcctcgcccagatcgatcgtgcccttatagtcgatgatgttcaattccgccccgagcaataactcgacaccgtatatccggcggggaaccacgtgcaggttgcggaagtaaatcggggagcacgtccccggtatgccgggggcatgctctgttatacctagtaatttcaatcctttctcggaggcggccgctgccatttcttgcagggtgctaaaggcatgcccactggctaccgtatgggtatgcacgtcaagtaacgtcttcataaattcgtctttaacctacccgcgaaggtagttattatttggtggatacccaattcccggataaaataagcgtcgtgcgagatcagcaagatcgtgcccctgtacgcacggaccatggaggtgataatctcgatgctttggatgtcgagattattggtcggctcatctaggataaacaggtccggagtctggttgctgatcatcaggcagcagaaagccaacctcattttctcgcctccgctcagcttcccgcagctcttctcccacgtgtcgtgcgggaagaggaaacggtttagcaaggtcttgatctcgtgctcttggaaatgacgctcgttgaaggcttgcgcttgctcgtacaccgtccggtcgttccggacgatcgagtactcttggtcgatatagatagaggagaaatccgcacggatcaaggaaccgctacgaggcggtaactggccggtaatcaacttcagcaaagtcgtcttgccggaaccgttatcgccttgtatcagccaccgttccccactcttgatctggaagctcatcggggagggccatagatcgccggcctcggcgtaaccgaaattgatctccttggcggtaaccaatatcttgccttcgtgtaagccggatgcgctgaaatccagtttcatgccttgaaggtcgggtagggaggagcgcatttgctttagctcgttggcaaggttctccatcttgtcctcgtgaacctcttttagtttggaggcgcttttctcggcgttctccttcaaggcgcccatcatgatcttggggattcctttctggatgctttgtttctttccccgggattcatgcttttgttttcgctcggctacctcacgggcggttttcctgaccctgcgaaactctttctccttcgcttccagtttctcttgcatggaagcctgttcctgttctttttgttccttgtagaaatcataattacccccgtaaagggtaattcccccgacggataattccgctatggaagataataggttcaataaggtacgatcgtggctgacgaccaacaaggtgatacggcaagacgtgatgaaatcgtataacttctcccggctacgcctatccagatggttggtcggctcatccaatagcaggatcgagggttggtggatctcgattccggagaggaaaaccttggttttctcgccgccgcttaatgtgcgcatcggttgggaaaggaggatatgctccaaaccccaagcgtgcagggcggcgaggctccgttcctcgatcgtccagtcatccgccagcgtattgaaattagagagggaggcgtcgccctcagtgatcgcccgcaaggcttctagtttcccgtcgatacgtagggcctgagccaccgtctggttatcatattgcccgaaatgctggggtacgtaatagggtggggtcggatagataatctccccttcctgcgcttgcaaggttccggccaagatacggaggaaggtagattttcccgatccgttgttcccgactaaggctaccttttgccccttgttgatcgttaagtcgatccccttgaataagacttggttgtccggatgtatatacgtgattttttgcgctacgatactcatagtgtgaactgatttaaaatgtgagatactaaaatggataagaaataccgatgatgatcggtttcacgatagcctcgaatctgtcgtcacgaaatcagccctatacggatagagggctttccggatggaaagaacgacatcttgagataaattaagcggctattctcattggagtaattatatagttatatagggacgcaaaggtaggaatagttttgggtttaggcaaatgagtatatactttcatgtacaaaagggtatgcttttgcccttgaaagtatatacttatgaggataaagcctagaatttctttgtttgcttaaggatatagaacttggctaagtcgcccgtgatgggttgcttctgctggtccagcattttcagttggccttcctctaccttataatacgtgatgtctcccccttcttgtttcgttgtcaagacgttaccgtccagcgtgtaagttcctttatcattaaaaataccgtctttctcgtcaatatattcggagcggagggtaaaggttttatccttgttcaatgtcaaggtcgttttaatacccggcgagctggcggctggtaatgtcccttcgtaaacgccccagtaatccaaggaggtctctgcgttgtgcatatccggtacttgggcggtttcctgcttgttcttgtctgtttgcgtggcgtctgcctttgggttgccgctacagctgaatagagctgcggctaccgctactactaatacatattttttcatgtcattcaattgaattataagttctcgttatttaaaaccagtttgtgggttgttttgttgcgaaccgatattcaaataataaggatcgtgtctgggttccatctggcgaaaaagcattatctttgtgttgtaaaacatagataacatttttattcgtaagattatgtcattaccaaacgatccgatgatgctattcagcttcatcaatatgaaacttcgtgacaattatccctccctcgacgatttatgcgaggatttgcaagtgaacaagaaatcccttcttacaaagcttaaagacgctggtttcgaatatagcccggagcataataagttctggtgatcgggagtaatcctagcccggtaaacctatgagattcgaaccataagtcaatgacttacgtatcgtaatccattgacttacgatgcgtaatccaatggatcgcacaccccggtcgacaaggttgtctccatcaagtctcactcgatatagttcttgacgatctctttccggtccgtatacttcgggtacttgaaagccggtatgccgagcgccatgatcgcttgtatcttgccgtcgatccctagcgtcttggcgagcgtatcttttccttcctgccggatggcggtgagcacaaagcccatatagatctggcttaccccaagcgattgcgccatcaaggaggcgttttgataagcgaggttagcgtcctcacttccgaatcggttggacttcggtgtatggatcagtagcagggcggtggctttccggagaatcgggtctttacccgccttgtgttcctctttcaaccgattgaataccggtacgtatttatagacatccttcataaacggcttgaccacacatttcacgacgggattcaataatagcttcgccaaggagtcgaacacgcctatcgtataatcgctcacctgccgtagcttttgcggatcggtgacgacggtaaacgaaaggctttgggagtttgtcgccgtcggtgcgcaatgagcggcctccacgatcttgtccagcatctccttgggtacgggcctcgaggtcaatgtccggttggaacggcgtgacttgatcagcaacatcacctgatccggcgtaggcatctggctgtaatcgatcgtgtgcgttttctccggcgggaattcgctgtgcgacacggagcccgtcggacatacgtccacgcaatgcccgcagacgatgcagctttccacacgtaccagcccgatcgtctctccggccctttcttgcgtgaatatatccgaagggcatacccgtacgcatttcccgcatttgatgcaactctcttggtctatgtttagtgtcatccttttcctccttttgataagtaaaataaaaactcctgcaaccatcaagattacaggagtctatatataaacaattattttattgtttagttgattacttcttcatagcttcctcgatagcaaccgctacagcaaccgtagcacctaccatcgggttgttacccatacccaagaagcccatcatttctacgtgagcaggtacggaagaagaaccggcgaactgagcgtcaccgtgcatacggcccatcgtgtcggtcataccataagaagcaggaccagcggccatgttgtccgggtgcaaagtacggcccgtaccaccaccagaagcaacagagaaatacgggtgaccgttctccatacattctttcttataagtaccggctaccgggtgttggaaacgagtcgggttcgtagagttacccgtgatagatacgtcaacaccttccttacgcatgatagccacaccctcgcgaacgtcgtcagcgccgtagcacttaactttcgcacgaagaccgttagagtaagctttctcctcgataacgttcacctcacctgtcatgtagtcgaactgagtctgtacatacgtgaaaccgttgatacgagagatgatcttagcggcatccttacctaaaccgttcaagataacacgcaaaggctctttacgaaccttgtttgccatctcggcgatcttgatagcaccctcagctgcggcgaaagactcgtggccagccaagaaagcgaaacacttagtctcctcgcgaagcaaacgagcggccaagttaccgtggccgatacccaccttacggtcgtcagcaacagaaccagcgatacagaatgcctgcaaaccgataccgatagcctcggcagcctcggcagcgttcgtacaacctttcttgatagcgatagcggcacctactacgtaagcccagcaagcgttctcgaaacaaatcggttgagtttccttacacattgtataagggtcgatacctttagcatcgcagatagcctttgcgtcttcgataccgttgataccatattcgtttaataccgcgttgatatgatcaatacgacggtcataactttcaaataaagccatattatttttttactttttaaaattcttatttactaggaataaagatatcagaaagttgaaaaccaatacaccgccacaacaagccacgtaaaacgccaaccacggtttctccggcttcatcacgaaatacgtgataagcgtagccacagccgtgataacactcagcccgatgaggacacgtgtaaatgttttcttattcattacgaggatcgatatattttacagcttctttgaaacgaccgtaagagcctttcgccttttccagtgcctcgttagcgtccatacccttcttaaccatatccatgaatttacccaagtggatgaattcataaccgattacttcgtcatcagcgtctaatgccatgcgcgtgcaatatccctcggccatctccaagtagcggggacctttagccaatgtaccgaacatcgtacccacttggctacgcaaacctttaccaaggtcttccaagccagcgcctacaggcagacctccctctgagaaagcggactgtgtacgaccgtagacgatctgcaagaacaactcgcgcatagcggtgttgatagcgtcacaaacaaggtctgtgttcaatgcttccaaaagagttttacccggaaggatctcagaagccatagcagctgagtgagtcataccggaacaaccgattgtctctacaagagcctcttggatgattccttctttaacgtttaatgtcagcttacatccaccttgtttcggcgcgcaccaaccgataccgtgagtcaaaccagagatatcagtgatctgagttgctctaacccactttccttcttcaggaatcggagcgcactggtggttagctcccttctttacaacacacatgtgttgaacttcatgtgaataaatcataatcgctaatttattatattaaagtgtaataaaaccttatgctaattttatagtaatatcgctttctctaaagatcgcacaaagataaattttttaatccagccatgcaagaggcgggaaaggtttaaggctcgatgatattaaaataagcgtccggagcctcaaaagtggagaatagctcttttaggctttcaagtttcccggttaccgataacttatgggcttgcagatttgccgctatattctccggctgcatgagacttgcgtagatgacttgtttgtctccttccaaagttacggtaggggccggatggagcctgccgatacggttcgataaggcgccgttctttaagatcaaggtggcttgttcgttcgtatcggttaagataatatttattattaagtctttatcggccgctttttctccatttatttggatagcgagcaaatcgaatagcatttcgggacttaggttctgggacatacgtgcccggtttgagttggccttgcctttgccagcgatgccttcggtcagttccatagctccggtcaggtagaaattacgccacgggccgctttccgcttggtagcccaattgagcgtacgtgtccgcaagtaattggcgggcgggtttatgctttggattagcgaaaacgagatggttcagcaaagtagccgtccaacggtattctccttgattgtatgcctctcgcgcctttttcattacctcgtcctctcctccgatagcctctacgtattttttaccttcttctaccggcgggagtgggttcagatgggcggggatgccgtcgaaccagccgaaatacatttgatattgggcttttacgttatggctaacggttccataatatccccggttggcgaactcgttggcgatagagcttggtaatttaatcatctctgctatttctcgaggtgtatatccttgattggcgaggtgaagtgtctgatcgtgtaggtagcgatacaaatcccgctgcttttcccagtaagcgacgatgttcttattgtcccaagtcggccaatggtgggtagagaaggatacctctacctgatcgccgcactccgtgatcgcccggtcgatatatttgctccataattggccgttccggaccttcgcccctcgtaaggtcagcaggttgtgcagggtacggttgatttcctcggctacgcagaaagctttcatctcagggaagtacatcatgatttccgagggagcctcggcgccgggtacggacatgaatacgatctcgacaccatcaattcgtaaagtctcgccctcctcggatatctcacgggtaggagggaccaagcccgtagttcctgccgcggtagtttgtcctaaaccagtacctatatttcctttctcatttttaggtagactgcggccatacatataggtcgctcttcgccccatggctacacccgccatcaggttctcgctgacggcatcttcaaagaaacccttggggccaatgatctcgatcgcttcgggcttattgggggcgttctccaatatggcgtctattcccgcgaaatggtccacatgaggatgcgtatagataaccgccttgaccggaagatcttctacatgtttcttcagaagattataacctgctagggccgtctctttcgagagcaatacatctatgacgatccaaccgttatcactacggataaacgtcatattcgcgaggtcgaatcctcgtatctggtatattttaccgggtaatacctcaaataagccgtgtatgcggttgagttgcccttgtcgccaaagactagggttggcggatgccggagcctcttgacgcaggaaatcccagacggttaatccatacacctcttttcctgtctcgtcggtaatggaagattcgtctatcgtggcgataaagccacgggtagcgtcttcaaaatcttgtttgttatcaaatgggagtgatttcaccacttgttcgttagcctctttcgtaaacattgaaggttccgtgttttgcgcatatacgaacaagtgactggtagagataaataaaagtaagaactgttttctaatcttcatgtttttgtggtttaagcggttcaccgttcagtaagatatcgtaggtaatcgggcctatctttttcatcataagtcctacgccacagtatttttcctgtgaaaggcgaatcgctttctctattttggcggcgtccccgatgttcccgtcgatatggtatgtagcgtggaatgcggtatataccatcgggatcgtatccgaagtctctgcggttacgtcgatagagattttgtcgaaacgtactctcattttaaggaaaagggagattacgtccattgcgctgcatccggccaaggcgaccagcattaaagccttgggacgggggccttcattattacccccgttctcggcagttgtgtcgatcgtaaccttatggccgtccagcaaggtctcgaaagtcgagtccttcgtccagtttaacgtgatttgggcggacatatcgtgttattgttattattatttcaatatttcttgaagtttagcgtcgatctcctcgccatgtaggttcttggcgatgatcgttccgtccttatccaccaatacggtgtgagggatgctgtttaccccgtatagttgagcaccggagtttttccagccttgcaagtcggagagttgggtccatgtgatattcaggtcctttacgcctttcgcccatgcgtcagccttgctatccaaggagatgccaactatctcgaaacctttgttcttgtatttcttgtaagcggctaccaaattcggcatatcccggcggcaaggaggacaccagcttgcccaaaaatcgatcaacacgatgttcttgccattgcctacgaactcggataacttgtgcgtcttaccgttcgggtcggccatctcgaagtccacgaacttcttgcctacggctacggttttcagtacatctaggtgagccatgagcttatcgatgttcggaacggccttgaaagcggagtccgccttggcgataatctcgttctgggccgcctcgtccaagctgtaacggaaatcgtataataacttggcggcggattgcttggtcgtattattcaatatgtaagtcttgacggcatcggttaccttttggtcgatctcgtcatatttcttctcggcggcgcttacgacttccttatcctctgatttcatgtcggcggaaagcttctccagatccgcacgcaaagtcttcatttgtgcttgcagggctttcaatccgtcattctccggtgttccagaaacggcggaagctgcctcatcaagaatagcctgtaatttaccattttccaatacgaatatgcttgtgaaaggggcgttctcgccggaagcggcacgtttgggttccacgacatcctcggcgaaggcgagtttgcgtagggcaggggcatcctgtgttcctttgaacgtgaacgtaccgttttgcaccaatgcgctatccattggggcggcgtcttgtacgccatattcatacaggtaaacgtattttccgtttagatcggtgttcgctacggtaccgttgatctcgtaacccggtttttcgctacatgcggctaggagcagggctgatgcggcaagagtaagatactttttcattttgtatttgtgttatgtaagtaatgtattaaaatatggaatattgacttcgcgaatatacgaagtcttttgtgaaaaccggacgcaaaccgatgaatagttcgcgcccggtatggatatatatagagtgtattaaagagggtgtattttatggggcatattttgcgaattggaaataacattttcctgaatgcaagtagggtagcattttattctccgagctatatgtgccacccagaacccaaaccggttgccggttgggatcatgatctcccgtgaagtcgaatccttggtagatatttttatcttctctggttggttgggggatatacgttgctccaaagtctttgcctgtaccgggcaagatatagatatgtgtcaggttcttcttgttgccgtatccgacacctgcgtttccaaagcggacatagcccccgtttacggcccggtaacatctcccgtggcttccgaggtttcctacgatccctccccggtagtcggaaccaagcgtgccggtcgctttttgctgtccgttgatttctcccatattgtagcaatccagtacgtaactgtcgtcgttatcactcgccttttctatgctccccacgatgcctccaatgccatggctgtcttctttatctttcggatagtctatatttgcccggttacagcagtaacggatgtgtgctccaccttgttttacataccccaagatacctcctgcgccataatacttggcgttcctgtttatggtgatatttccgtggttaacggatttataaattgtaatggcatcctcagaggcaccggctataccgcccactccgtattctttatctcctgcgataccttggatcgtaccgaaattagctgcgtcataaacctcaatgccttttccagcgttttttccaatgataccgcctatgttatttgtggctgatagcttacccaaattcacgactttattgatctttacggtagttcttgctaccatactcccgaaaatgcctccgatataattggatcctgaggagatatcactgtaatttactagattggaaaactcacagtgggatgagcacgatgcttgtccgataattccccctaccataatggcgctattattcccattattaaatgtttctgttttcacgccgcaatctgatatttgagtatcgctcgcatatccgatgattcctccgactgtacttctgccgtaaatggaaggttgcgtgaagagtcttctgagggtagatttatctgcatatccgacaattcctccaacataagcggcattttctcgatagggtttttccgaatttatgttacccgggaaaataggtcgtggaatcttgctcacgattacgttcgtggtactgaattcgggggtataggttcctgtcaacgtcccattatataattttccgatgattcctcctacgttatttcctccttttattttgatgttgggattaatcaccaatatttccggatccaaaagaatttctttccccggttcttggtaagataaggctccggctaaagtgccacaaatccctgaagaagcttcaagggattcattatccatatacaatcgtgaggccggggtaaattgtatttgggtatcatctaaagaaccgaaaatacctcctataacagactgcccggttatcgaggcatgaaacaaggattcccctttaagctctatcgtaaatgcgttagcgtgtgttttgtgggaatatccgatcattccacccacataactacccccttggatttgagaccgatttgccggattggacaactggaagttctcgatggcgatgaggatattggtaggggtttccgaccggatctgaccgatcaatccgccgacataggagctacctttgatcggcatgtcgatggttatgtctttgaaattggatgccgcctgtaagaatgcctcaccgatcaatccgcctacgttctggtttccggatatcgggaaatcgtttaaggtggtatgttgcagcttaatttttctggcatcgatttgaccatataatttcccgatcagaccggccacatgattattccctctcaagtttttgaaaatcccgtcgctactgatatcctccacttgaatggaagcgttctcggcccagccgatcaacgctccgatataagagctgccggattccgagaatgagacgcccaatcgcacattccggatactgatttgtgccaacgactgggcgttgccctcgatatagcctattaaaccgccaactttatccttcgtggacttgatattaccgtttaaggttatattctcgattcgtatattcccgttagctactcccgcaagcaatccgcagcaattccccggatactctatatccgctccttctatatcaagattccggatcactgccccgtcgtgtaaaatggagaaaagcccgattgcgtcgctttgctctccaccgttcgtcccgagataggttaggtttagtatcttatgggaatcgccgtcgtagttccctgcgaacggggcgcttttataagcgttaccttgatacaggcaattggggataggagctttgatgtcggctatttgcttgaagaattgcccgtatccgtaattacggtcgtacgtggctaattgagacacgagataggcgaaatcgttggtggaagtaatcagataaggattctcttctgtaccttcgccattcagcatctcgtaaatatatttagtatcacgtaccatactgaccatcttgtcacggaatgtcagatgatagcttagtggatagacgctgccttcttcatcgaattttaaccaaagtatatagtctccatcttctaataccagattattggggataaacatttcacaggaaagaatccccgcgtttttccggatcttaccttccatgagctgtatggagttatcgctcagcgatctcaactggaaaaagatctgttctctcgtatcttgtatgggagttttgccttccggcaaggagaacgtgcttattagatgagattctgtctcttgcaaggtcgatccgcagtcgtttcgtatgatgtcatcgtccgcgcatccaccgagcaagatgataagcatgcatgcgcatatattccatattgttttagtgtatgttttcatgtttgtttgttcgtttatttataaattaggtttatcaaattgcatctcggatttcttagggatcggaaagctgcctgtttcgttggatggtatttcccattttacatcaaagtcccatccagtaaaggtcttttccgactttaagtcttgtaagctgaatatgttcataatcacaggattcggttgctctacagtgcccagcatgcagtaattcccaaaataagaaacggatgcgggaggtgcgaaaagataccaattctccccgacattcaagttcctgcctacccttacgtttggattgacaactccaattagggcattggctcttttgtttgagcgtcccatatttatacaatcggagataaggcagctttgctgaagttggcctaccaagcctccgctgctatattggccaatctctccggcgtttaagcattgtgtgataacgacggagttttccacgaaatcatcaagagtggctgaaaccgaattgccgaaactgactaacgctagcgcacctcccatcaaggctacagcgggaacaccttcggggaaagtgataactgtaacaaaaagcaaggctgaattgaccgcgcaacaaacaccactgacaaccgtatgtagaacttcttcgttttttttgcttttaaggatctgtttggagagcaaccctctcttataattcatcgcgtcactataaatctggtggtttgccccactttcaaaccattctgttagtgtctttcgattagacatgaacctatttgtcatgtctttgctcctcaatttgatgcttgcgaacgataggttatctattttattggccagtttcgtgtccatgtctgattccaacatggcgatatcatgggtaatgacacctttcagcctctctgtttctatagtctccggatgaccgtgtgaaataagcccgaatacgctaaaaccttctgataaaatatcgatatcatttaagacgaggctaagtactgtaagggcgcagttaacaaggatttctccgctttctcccacgattttagcgaaagggacaaatccgacaagagtagacgccagctcgaatgtggcaaaccccaaggatacgccatccatgatcgtccatttctttgcgtcgcctacctcgccgatcataccgccgaggtatgaggagcctgatatcggcgcgaaattggaacaatagttcatggcaagcgtattccctgcccttcctatcataccaccggcatattcatggtaggaggctacttcccccagattcgtgttaatacccaacgagccggcaaggatggaaccggctattcctccgctataagaggaggcgattactttattgaaattcgccgtattggtgatggaggccaagggagcgaatcctaaaattccaccagcgaaggatgaattagcctcgatcataccctcattatacgatttataagcgccaagttgcgcctcaccgcataatcctcctatataactgtcgccgtttatattccccgagttcgagcaaaaaccgataaacgtgttattataataagttttcggctgggtagttaccagtgtgcttccgataattccccctacgcccctgcttccttgcaccgtcccgctgtttcggctggaaatgatggtgctcaatccacttcctccggcgatcccacccgctcctacattatatatagaattggcaggaaggtttccgggaggagcggttgtggatgcggcacctttgatagtgccattattgctgcatgaatatacatagagcgtatcggcgtacccaacgattcctccggcacaattgtaagatgcggttaccttggtattccggttgtgggagttcgtgatttgtgtcattgagtacactgttcctccgccaaggattcctcctacggcgatcgccccgtttatagtgcaatcctctactgagcaggaatctatccagagatttacgttcgggtctaccatgccggcgatcccgcctatggccatgccgtccgtgactacgccatcgctacggctttcgatggtggatttttttactacgcacccttttataaatgtcttattgatgcttccccccttggtggtaacggctcctacgatagccgatagcgctccatagccggttatggtggctttctcgatggtgagattcgagatgatggcttgatttacgaagccgaacaaactagcgcccacggcgtttttatctaacattttcaaatcccggatcgtatagccgttgccgtcataatagcccgtgaaaggataactggctgataatccgatctggtaccagttgccctcccagccgcattggtcattatagttggccatgctaatgtcattttgttgttcgaagcaggtggaggaattaacaaggttaccattgttgtggaagttgaggatcgcttcttgtatcttcgccaaatcatcggcagaggttatccggtacggatcttccggcgtaccgttcccatacaggccgattcgctcgtcacggttggtttcggtggagatcccattctcactgacggtaatgtagcaccccatgccgaactccccattccgcccgtcaatgtccgggcaatccgattggatggtatattccatatatagtagctggtatttaccctccttcagccctttttccatagtgaatagggaagtcccggataatcgccggtgcttggctttccgttggataatgttcccgtcgggagtcttgatgtggaaagtcaggtctccatacgtgaaatcttcggtttctttcgtgaaactgatcagatcgtgtactccttcataggtgtcctctgtggaggccgggatatccggaatgtttttgtcatccgaacatcccatcagaatcaaaagaaagaaaaggagaaaaaaataatttgtcttcatatatagcttgcttttaggattaacagatatcgcttcaatatgcgaatagtaatcctaaaagctgtccgtgtggcgcaaaacatttgtccgtgtggcgcaagtttttgaaatatagtattttaattttctttttctttctccgcaagttttcgatattcgttaggagacaggccatagctctgtcggaaaaggcggtaaaataccgagcgggaagcgaatccggagtcatagcatatttgatcgatcgagagggcggagggagaggagagtagttcggcggcatgctttagacgaaagtcataaatatattcgcggacggtcatattcccgccgtaagtacgtacggcttccatcaagtaggtacggttggtccccaaacgttgtgccagatcatcccggttcaaggtgggatcggtgtatagcttttctttttccaataactcgttcaagtttatgaataaacgtaattcccgggaaagatcgttctcgggtatttgcttaatggtttccaccgccttattctcctgccggatctgttcctgtatacgtctgtaaagcacttgattctttgcttttagacattgggaataaatgatatatcccgctagcaaaaggacaaggagcaagcaaccggtaaaggcggcgaacatccagttccttgcgtattgcctctcttggttgagccggtctacctcgtaaatagtccgtagttgatccatccgagaggcgatatccaaccggtttaccgagtctttcacctgtatatacgtatgatagagcgatatacaggaccggggatctccggaatgagccagaagttccgctttcttcaacaaatcgtccatatagaaagataggtcgccctcatgagcagctaacaggatatccatatccttgatagccccttggtaatctcctgtcatttcccgtaattctcggcgagcttcgtaaaaatgctcataggcgttggccgggatttggggatgaataaaccggactgcctcatccaacaatcgtctcgcctcttttatttgccctttctttaggaaagagaaggcttggagagagcgggaggtgacaggataatgtccggtcgggtccactttcccatgctcgtccctccagttgacgagggcggcatagctgttggcgtaacgggatatgcgttccgtgtcgttcaccttcagggcggtcatgaagagccattcgtaaagaacggccgagatgtagagtacttggttctcgccattctcgtaagtggggcatatagcgatccctttttccagcgaggtgagggcttggtcgtataagccgagtttataatacatgctgccttgtacctgcaaggccatcgtcatgcctaccggttgtttaacctgttgcgccgtctcgaacatggttgtggcttcctcacgggcctcgtcgaaccgtctttgcttgaacaatccggatatataagtattataggtggagaagtagaaactgtattgcttggcatccaatataaaaggaaggctttcctgcgcctcgatgatagccgaatccacggagtagaaattaaagaggcattgtatacgattcaatcttgattgacagatagccggagtatcgcaccggtcgatagcgtcgttgagcgtagcgtcccagtcggcgatatcgttggtggacatggctatacgcatcagtagatcatgcttttccttacccacgctcgctgcggcccgttgtcgcaatgaatctgtcgggggatgtccttgcgcttgtatctcgttatgagacgagatcaggcagataagcgataataggagtgcaagagggctttttcgcatcgaattttgtgattaactaacgttaatagaaggtgtaaatatacgaagtcttttgtgataattaggtgcaagttgatgaatagtttactctattgtgccattgaagtagcctacagagtaaacggattaaaaaaatacaataaagcatttgtttgaaatagtttgtaactggcttataattagtggaatataaattatgatagagatttgagtaaaacacgtacatgttttcgaaaaaacatgtacgtgtttcttgaaaattacgtacgtgtttttggaaagatacgaccgggtaaaaaaacagccaagtaaaatatacaataagctacctgttttctcgtgttcacttcatggtgacacaccctcttcttgttgaaggttgactatgtctccaatgaaaatctgtccaaattattgaaataagtggagttttatgtacttttgaggactaaacaacggacgattgagacaatgacatttaaagaagtacttcaaagattccgtaccggatcttttaccgaaagagaaaagggagcgaagtttgagaaactgatgaagagatggttccaaacggaccctcgctatgcggataaattgcaggaggtttggctttgggaggaatttccgggaaaaaaggatttcggcgggaaagatcttggtatagacttggtggcgaaaactgatttgggtgattattgggccatccagtgtaaatgctatgacgagaaggccgtcataagcaaggcggtcgtagactcctttatatccaccgctcatcgtgcgtttatagatgatttaaccttgaagaccacgtatttcagtaacctgatctgggtttctaccaccttgcgctggggagcgaatgcggaagagacgttgaaaggtcaagacatttcggtgactcgtatcaatatgcatgagttggaggcttctccggttgattgggataaactcttgaaaggggatacgggaaaagcggctttacgggaaggtaaacagcctcgcaagcatcagttggaagcgatgaaagcggctcatgaatattttagggtacatgaccggggaaaactaatcatggcttgtggaacgggaaaaacgtacacctccttggagatcatagagcaagagaccgggggcaagggactgattttattcatggtccccagtatcgctcttttaggacaatcgctgaatgcttggatgacagatacgaaatacaggatgaaggctgtttgtatttgctcggattccaaggcttccaaaaggaacgatttcgataatgacgagacgagtatcatcgataacccattgcccgccacgacaaatatcaactcgataaaacggcaattattaggctataaggatacggacggactggttgtcgtattctcgacctatcaaagtatagatgtcttggccgaggcgcagcgagcgctattggaggctgatccgtcttatggtatattcgattatatcgtttgcgacgaggcgcatcggacaaccggttttaagcaaaaaggtcgtgatgagagtcattttactaaaatacatgacaatgacttgatccgggggaaaaagcgtctttacatgacggctaccccacgttattataatgacaatgccaaggcgacggctaaagacaaggatttagtgttgtggagcatgaataacccggactattatggcgaggagtttttccggatcggattcggacgtgccgtgcgtgagggactgctgacggactataaggtattggtgctgacgattagcgaggatgatatcccggattctatcctagaggatgtcaaggataagcaacaaaaggaaataaagatggacgacgccagtaagctcatcggttgtatcaatggcttgtccaaacgtataaaaggagataagggggttacgaaggaggcggacccggtattgatgcggagggccgtggcgttttgctcgaccattaatccgagtgagcgggggagcggtatctcttccaaggggtttgctgccgtgatgcctacgatggtgagaaaatataaggaatccttgtcggaggaagtacgggaagaggtcgtggatatcgaggttcaacatatcgacggggcgatgaatgccgctacacgggaggagaagatcgcttggctgaaggaggagaccggcaatccgaacgagtgccgtattctatcgaacgtgcgttgcttgtccgaaggggtggatgtgccggctttggacgctgttctttttgtcgccgcccgtaatagcgaggtggatgtcgtgcagagcgtggggcgtgtgatgcgtacgttccacaagggggcttcggatgagaagaaatatggttatatcattgtcccggtagtcgttccggcggatgtggagccggagaaggcgatggaggataacgagcgtttttccgtggtctggaaaatcttgaatgccttgcgtgcccacgacgatgagtttaacgctacggtcaataagatacatttgaataaggtgaagcctcccaaggtggttgtcgccgggataccgcaaggctcgggtcggatgcacgggaaggattggatgcccgatccgcaggatcaacagacgggggcgaccgagctaagtaatgaggaaatcgctcgccagttggaacttcgtttcggttctttgcaagatgggatctatgcgaagatggtcgagaaggtcggagatcgcctgtattgggagaactgggcgagggagatcggcttgatcgcccagaaatttatagagcgcatcgcccgtgtcgtgaaagagggattgcacaaagaggctttcgttgaattcttgaatggcttgcaaaagaacttgaacccttccattgacgagggacaagcggtggagatgctggcgcagcatatgattacacgtccggtattcgatgccttgtttaaggactatcagtttgtcaagaataatgcggtcagccgtagtatgcaacgtatgttggagctactggagagcgaggccatggaaaaggatacggaggtattgaataaattctatgagaacgtgcgcatgaacgtaggcgatattgacaatctggaaggaaagcagacgcttatcaagaatctgtatgagaagttcttcaagggtgctttcccgaagaccgtggataagctgggtattgtttatacacccgtggaatgcgtggattttattatccattccgttgacgatatcttgcgcaaggaatttgattgcagcctttcggatgagaatgtgcatatcttagatcctttcacggggacaggtactttcattacccgtttgctacaaagcggtttgatccgtccggaggatctggaacgtaaatataagaatgagattcattgcaatgagttggtcttgcttgcttattatatcgctgatgtcaatatcgagagcgtctttcatagtctcgtaaagcgagatacttatttgccgttcgagggcatttgcttaacggacactttccagacaaccgagaacgaggagaaagtcttggatcagacttggtttcccgagaatgcggcgaatgtggataagcaaaagaaagctccggtacgggttataatgggtaatcctccgtactcggtcggacagaaatcggcgaatgataatgcgcagaatttgagttacgctcatttggataaacggattgccgagacctatgtgagagctgctaatacaactctgaaaaactcattatatgacagctatataaaagcgtttcgttgggcgagtgatcgcatcgcggattgtaaggatgggggtgtggtagctttcattagtaatggggcttggattgatggcaatgctcaggaaggatttagaaaatgtcttgaggacgaatattcgagtatatatgtgttgaatttaaggggaaaccaacgtacgagtggtgagttatctcgtaaagaaggcggtaaaatatttggttcaggttctcgtacgcctatatcaattactcttttagtaaagaacccggcaaagaaagggaaagcgacgatttattatcatgatatcggtgattatttatcacgtgagcagaagcttaaaaagattagtgagtttggttccgttgattctagtgaattacagtgggagattgttgctccgaatgagaaaggggactggattaatcagagagggaatgtgtttgactcattgataaaattgggagataaagaagataagaaaaataaaatgacagtgtttgttccatgctatggaagaggtttggctacttctagagatgcgtggtgttataatagtaatgaagagaatctagaaacaaatattcaagtctcaattgatttttataatagcgaggttgatcgttatcaaaaagctgtacaagaaaatcctgacattaaagtatatgattttataaaatatgattctacgaagttctcatgggatagagctcaaaaagaggtggattgtcctaagggcgtgaaatattcatttgggaaaaagtctttgagagatgccatgtacagacctttctttaaacaacattgttactttaatagaaagctgaataactgtgtttatcaattgccgcaaatattcccaacatctaaatataaaaatttagtgatttgcgtgaaaggaatcggagacaaagatttctcttgtttaattgctgattgcattcctgatcttcaagttatttttaatggtcaatgcttccctctctactggtacgaagaaaacaagaacaagcagcaaaccttgtccttattcgataccgaatcaaatgatgatttcattcgtcgagacggaattaccgactggatactgaaagaagtccgtacccgtttcggtaatgcccggaagatcacgaaagaaaccatcttctactatgtgtatggcttgcttcattccccaaaataccgggaagcctttgcggccgatttgaagaaatccttaccacgtatcccgatcgtggaagatatagacgcattcctcgatttctcctatgcgggtaagcaactggctaatctgcatctgaattatgaggaaatacctgcgtatgagggcgtgacagtcattggcgacaggcaaaaggaggaagccccggatggtcgtatgattgccggaactacggatctatatgcggtcaaggtggattataaatactatgaggtagagaaaatgcgattccccaaaaaggggcaaaaggatacgattatctacaacagctcgattcgtatagagaacatacccgatgaggcgtatgagtacatcgtgaacggtaaatccgctatcgaatggatcatggagcgctatcaagtgaaaaccgatccaagtagcttgatcaagaacgatccgaatgactggagccgtgagcatgataacccccgttatatcttggacttgctactctccgtaatcaacgtgagcgtacaaaccatggagatcgtcaaaaagttaccggatttaaagttggaataagaaaatagtaaaaggggcttcttgtgaggaattcatatttattattttataatctagagatacacctagggataaagcttgcatgcatataaagtctttatgtaaaggagctaaaaaggtgtgtttatacgataaagtattatgtatttggggcggacgatgaaggagttgatctatattgtcagacctgttttaggaaatcggcttgtaaagtgttaatcattccttcggaaccaattttagggtgatttttcaatgaacatatccccctgtctttttattaatacggatttttttccttatattcgcgtcacttttgaacacgtatcaaataatttctaaataaatcaattaagaaatgacaaagagtgcattacaaatcgcaagagcagcttaccaaccgaaggtacccgctgcgttgaaaggtgcagtgaaagccgttgacggcgagtatactcaatcagtagccgatcaggaagaaatcaagaaattgttcccgaacacttacggaatgccgatcgttacattcgagaagagtaacgaggagaaggctatgcctgtcatgaacgttggtgtgatcctttccggtggtcaggctcccggtggtcacaacgtgatcgctggtttgttcgatggtatcaaggctcacaacgcagattctcgtctgtatggtttcatcttgggcccgggcggtttgatcgatcataaatatatggaattgacggctgatattatcgacgagtaccgtaacacgggcggtttcgatatgatcggttccggacgtacgaaattagagacgaaagagcaattcgataaaggtcttcagatcttgaaagagcttgatatcaaggctttggttattatcggcggtgacgattctaacacgaacgcttgcgtattggccgagtattacaaggctattggcgccggcgtacaggtaatcggttgcccgaagacgatcgacggcgacttgaagaacgcccagatcgagacctctttcggtttcgacacggcttgtaaggtttactccgaggtaatcggtaacatccaacgtgactgtaactccgcccagaaatactggcacttcatcaaattgatgggtcgctccgcttctcatatcgctttggagtgcgctttgcagactcaaccgaacgtttgtatcatctccgaggaggttgaggagaagaatatgtctttggacgatatcgttacttacgtggctggtatcgtggctaagcgtgccgccgagggtaacaacttcggtacggtattgatccctgagggcttgatcgagttcgttccggctatgaaacgcttgatcgccgagttgaacgacttcttggctaagcacgacgctgagttcaagatgatcaagaagagcgagcaacgtgcttatatcatcagcaagttgacgaaggagaactctgatctgtacgcttctcttccggagggcgtagctcgtcagttgtctttggaccgtgacccgcacggaaacgtacaggtttctttgatcgagaccgagaagttattgtctgagatggttggcaagaaattggctgagtggaaggccgagggcaagtacgtaggcaagttcgccgcacaacaccacttcttcggttacgagggtcgttgcgccgctccgtctaactacgatgcggactactgctactctttgggttacacggcatcttgcttgatcgccgccggtaagacaggttatatgtcttccgtacgtaacacgaccgctcccgctgatcaatggatcgccggtggtatccctgttactatgatgatgaacatggagaaacgtcatggcgagatgaagccggttatccagaaggctttggttaagcttgacggcgctcctttcaaggcattcgccgcaaaccgtgacgagtgggctttgactactagctacgtatacccgggtccgatccagtacttcggcccgacggaggtttgcgaccagccgactaagactttgcagttggagcaagcttaataccgacttatacattatataatatataagctagggaggatgtcatttatttggcatcctctttttatttacatacatttgccacgagatcttaaacctaaaaataaatctttataacacatggattccatgaacaagaaaatcacctatctattgctccttttgatgctgatacctgtcggctcgttcgccaaggagaaacgtacgttcgagatcaaggacggtcatttttatgtaaacgggaaggtaaccccgatcctctcgggtgagatgcattatcctcgtatcccccaccaatattggcggcatcgccttcggatgatgcgggcgatgggcttgaatacggtcgctacctatgtcttctggaacctgcacgagacggagctgggtaaatgggatttcgagggagacaagaatctggccgagtatatccggatagcgggagaggagggattgatggtgatcctccgtcccggcccctacgtatgcgccgagtgggagttcggcggttatccgtggtggttgcagaatataccgggcatggagatccgccgggataacccggagttcttgaaacgcacgaagctttatatcgataagctttacgagcaggtcggcgacttgcaggtatcgaaaggcggccctatcatcatggtgcaggccgagaacgagttcggctcttacgtggcgcaacgtaaggatatccccttggaggagcatcgccgctacaacgccaagatcaagcggcaattggcggacgccggtttcaacgtgcctctgttcacctcggacggaagctggttgttcgagggcggttccaccccgggagcgttgcctacggcgaacggggagagcaacgtggagaacttgaaaaaggtggtgaacgagtatcacgggggagtaggcccgtatatggtagccgagttttatcccggttggctgatgcactgggcggaaccattccccgatataagcgattccggcatagcgaggcagacggagacgtacctccaaaacgatgtctctttcaatttctatatggttcatggcggtacgaatttcggcttcaccagtggcgccaattacgacaagaagcatgatatccagccggatttgaccagctacgactacgacgccccgatcagcgaggcgggttgggtgaccccgaagttcgactcgatccgcaacgtgatccggaaatacgtcacctatgacgtccccgaggctccggcccctataccgctgatcgagatcccgtcgatctccttgacgaaggtagccgatgtgttggccttggcgaaagaaggggaaccggtaacgtctccgacacctctcacgttcgagcaattgaaccaaggatacggctacgtcttgtactcaacccatttcaaccaacccctgaaaggccgtctggagataccgggcttgcgtgattacgctacgatctacgtggatggcgagcgtgtcggcgagttaaaccgttgtttcaaccaatatgcgatggagatcgatatcccgttcaacgctaccttggacatcttggtggagaacatggggcgtatcaattatggcgaggagatcgtccgcaatacgaaggggatcatcagcccggtcaagattaacggcagcgagatatcggactggaagatgtacaagctcccgatggaccggatgccggctttggcctccggcgaaccttatgtctataagaatggctcgcccgaggtagcggcgttggggaataagccggttctctacgagggaaccttccacctgtctgataccggcgatacgtttatcgatatggaggattggggaaagggcattattttcatcaatggcgtcaatatcggccgctattggtacgccggccctcagcaaacgctttacataccgggcgtatggctgaacaaaggagagaataagatcgttatttatgagcagctgaataatgaccggaagtcgagcgtacggacggtcaagactcctgtcttgacaaaactaaagaaaattgcagccatggagaaaaagaatcgtttgatggaaaaaacagtaagcccgtttagcgtggatgagacgatgcggcggatcgaggagattatcaagtctcaaggaggttccgtgttcgccatgttcgatcatgggcgaaacgctagcgaggtagggatgaagctgcctccgaataaggtgatcgtcttcggctcgccgaaagtcgggactttattgatgcagcaagatccgtctatctctttggagctgccgctacgtatctccgtttgggaagatgcggacggcaaggtttggattggttccccgaatctggagacgatcgcctccgaatacgggatggaaaacagcggcgtcatcgagaagatgcaagaggccgtaacgaatatcgtgagtaaatcgatagccggcagccggtaaggctcacggatctaatgcgataagagcttaggaggatgtcggtaaaacggtgtcctcttttcttttatatggcccaagaggctcatttaccgtgctgtagattgataataaggtttaaaagtcttcgaaaaaattaggaatagattgtatttttttatgcggtttttaacatattgttgattcttgtgaaggtgtctttttgttaacaagaataagccttattgggtctataatagctatttgtacgaacacatatccgcaagttcaagggaatgtgaaaaaaatatgcatactattgttgtttattaagaataataatttatatttgtacccgtatccgaagagtggatataattattaatgttaacctatttttgtgttatgatgaacaaacagttggcttttgttaaaagcgggctgggtttggcactttgtttccttatggtcggtgcgggtgtaacccctccaatccacgcgtctaacgcgaatgtgtccatctcccaacaagctaagaaagttaccggtacggtaactgacgcaaagggtgaaccccttttgggtgtaaatgttgtagtaaaaggtactacaaacggtacgattaccgaccttgacggtaagtattccttggaagttgagcccaactccattttagtcgtttcctacattggttatgtatctcagcaaattcctgcttcgggagaagtggtaaatgtgactttgaaagaagatacgcaaaaccttgatgaggtagtagtagtaggttacggtacgcagcagaagaaagatatcacaggctccgtggcagtagtcgatacgaaagaccttttggcatcttccggatcttccgctacccagcagttgcaaggtaaggctgccggtgtatatatcggtcagtcaggttcccccggttcccagtctatggttcgtattcgtggtatcaatacggttaatgataatggtccgttgtacgtaattgatggcgtatcaacacgtaaccaagatttaagctccttgaacccgaacgatatcgagagtatgcaggtattgaaggatgcctcctccgccgctatctatggtgcgcaggcggccaatggtgttatcttgattacgacgaaaaaaggtacccgatccggtcaacctaaattgacttatgatggatatgtcggtgttcagaaaacaggcaagcgctatgacgttttgaattctatggatcgtgtgaacttggaatgggacgcaaaggctagtaactatgcattgttaggttccaatgaacttccttcacacgtgcaattcggaacaggtgaacgtccttctattcctaattatttgacgcaagctggtgcgggtggtcgtacggatattaatcccggcgattataattacccgggtacgacttatgcgccgttctctgacacaaattggtgggatgaggtagaccgtgcggctatgattcaaaaccatcaagttggcttatctggtggtactgaaaagggacaatataatttaagtgcgaattacttcaagcaagatggtacggttattgattcttactaccagagatatcaagtacgtgctaacacctctttcaatgttcgtgattggttacgggtaggagagaatttaacttatgcgtttacgaaagataatggtttgaactctagcggcgctgagagtaatccatattcttggacttatcgtgcttctccttatgtaccggtatatgatatcgcaggtaattttgccggttcaaaattcgctggaacgggtaacttccagaacccggttgccaatcaaaagagaaataaggataattactatacacataaccgcgtatttggtaacctatgggcagaggccgatattatcaagggattaacttttagaacgaatttcggtttggactatacgaatggttattattatcgtatggaaaagaagaaccctgagttttctgagtcaatgggccaaaacaattttgaagagcaatctgattttaattatcgttgggtttggactaatactttgacttacgacaagacattcaatgaggttcataaattgactgtcttgcttggtaccgaggctattcgtgatggtttgggacgtacgctgaaaggtcgtcgttacaattatttgtacgaggataatacgaatacttgggagttgaatatgggtgagaataacgcacaacgtatcgcagaatcaaaatataaaggtgaatttgccttgtttggtctgtttgggcgtgtagattacgcttataataataagtatctgttgacaggtattatccgtcgtgatggtgtctctcgtttctcggagaataatcgttacggtgtattcccttctatctctgctggttggcgtatctctgaagaggcttttatggagaaaacaaaagactggttagatgacttgaagcttcgttttggctttggtgttaccggtaactcagaagtgcctcgtattacgaacttcgcctacgaatatagaacattgccaaagaaaacaaactatgactttacgggttctaatacctctacctctttaggttatcgtttggataaatttggtaacgaggatacgaaatgggagaccacccaaatgtttaatgtcggtttggatggaacattcttgaacggcaaattcggtgccggattggagtggtactataagaaaacgacagatatgttgattgcggctcaatattccgctttggctggtgaatcttcaaaaccgtacatcaactttggtgatatgaagaatacgggtgttgacttcaacttcaactatcgagacagtaagggcgattggtcatgggatttctctttgaacctatctcattataagaatgaggttgttaagatctctgaggctgatgatgcttctatgtggggaggcggtacacgtatctctggtaatgtaactcgtacgacaaagggacatgctatctctgagttctatggatataaggtgaatggattctatgagaacgtagatgaagtacttgcgttacctcctttgggacaagaagtgaaaagtgcggaagacgctaaggcttgggtcggtaagtttaaatttgctgatacagatggaaatggtaagttagatggaaatgaccgtacctttatcggttctcctcatcctgacttgatcgccggtttgaacgctactgtaacgtggaaaaactgggatttgacggcattcttctattcaacgatcggtaatgatttgttcaacaatacgaagtactttactgatttctggttattcgagggtaataaatcttctcgcatgagagatttgtcttggaaaccgggtgctgacaatagcaaagctgtcttacctattttggattatggtgatacctattcaggaacgaactctagctcatactatgtagagaatgcctctttcgtgagattgaagaatttggtcctcggttatacattcccgaaggagttgatgaagaaggctacaatctctaatctgcgtatttacgtgcaagctgagaacctatttaccattacaggatatgatggtttagatcccgagtatacaaatgcggaaatgaaagatgtggatgacaacggtgtcggtgctgacttgaagagaggtattgatatgggcggttggccttcaacaagacgtttcttgtttggtgtaaactttgcgttctaaggtgtgtatgttttaatttaatttaaagaatcgttatgaaaagtaaatatattttggcgataggctatcttgctgcgctttcatttagttcttgcggcgatgacttcttggggaaagaacctcagggagcattgacaccggacgctctagccaatccaacgggtgtggaattgttaactgttagtgcctatgcaggcttggctgttccggtggatggttatgatccttatcaagcatctccatttaactgggtatggggtggtatttatggtggtgacgccaataaaggttccgacccgggtgaccaatccgtggtgaatgagatagagatgtataatactctgtctactaatggctatatagcgcagaagtgggcgtgggtttatgtaatggctaaacgtgtgaacttagctcttcaagcttggcaaggcgctgaaggtatgccgggtatgagcgataccgatcgtaaaagccgctatggtgagttgaagttcttgcgtgcattggcttattttgagggaattcgtgtgtttggtccatttattccttgggttgatgagacctatacggagaatgatcctaaagtacataatgatattaatatttatgataatgtactgaaggatattgacgatgcgatcgctaatcttccggaaactcagactgaagttggtcgtgcgaatgtttgggctgcgaaagcattaaaaggtaaaatcttaatgcataaaggagacatcgctgccgcgaaaactgttttagccgatgtcgtgaataatggtacaaccagtagtggggcagcttatggattggaggacgatttggataacaacttcaatgcgctgactgagaatggtaaagaggctattttctctgttcaatattctgctgctgacgaaaacactggtggtgctcctttctgtttgaattatccgcataactcaggtcccggtggatgctgtggtttctatcaaccttctttcgaattagtgaactctttccaagtggacgcacaaggtttaccttatttgaatggtgaatatagaaataaagcgactgtttcaagaaaaggtacgggaacaaatgagccatttgtcgtaacagataatagtattgcggtagaccctcgtttggattttgctgtaggtcgttatggaatcccttacaaagattggggtatgcctaaggatgactgggttcgtaatcctgtaaatggtggtatctttatgccgaagaaacacgtgtttagtaaggcggaagaggccgctggcatgaagaacttatttaatggttgggcaccgggttctgctatgaatatgcaatatcttagtgtgcgtgacattaaattgttgtacgctgaagctttagctgacgctggtcaattgtctgaggcgatggcacaagttaacgatgttcgtagacgtgcagctttggatgtgaatattattaagttagaaaacggtcaagcggccgcaaactataaggtcgctgaatatcctacgtctcatgcggctttcacaagcaaagatgtttgtatcaaggcgatccgtatggagcgtaagcttgagttggcgatggaaggtgaacgttggttcgacttggttcgttggggtggtgatgtcatgtcttcagaattgaaggcttatatcgattatgaaaagcaatatattccgaagtttgcggcagcctctgtgcttcctgcggcaaagactatgcttcctgttcctgatgaccaagtattgaccatgggtaacgacgagaacggcaaaccttatttggttcagccggatgcttggaaataaaatatttatttcgaattgagaataggatacttgatttgcaagtatcctatttcttgcttgaagtaagtttgtagttgtatatgtatttattaatttaaatttttagagccatgaagaaagttctgtttattatgcttgcattattatcaatgcagtttatgtatgctcagcaaactaatattgacgtggacaaagaaaatatagaagagtctatattacaagctaatgcggcaaatgggatagttgctactatatcaggccctattaacgtaacactaaatgggggttatgcccaagaagagtatcatctggaatatagccctttaataccgggtgctagattggaatggagtatacgagcaccgcaagcttatataacaccttggacaaatcattgttcggttagtttttatgcagttggtagcgctcgtttagtatgcgatatttatgatggtaatacgtgggttggcgctgggacaacttatataaatataaggtaatggtatattaaaatatctgaaattaagaggggcgattaagatttctgataaaaacttaattgtccctttataatttaaaaggatgattttagaacttaaagttttgttgttataagccttattgatatgattttttatcaatagattaatgaattttcccaaccaaagaaagtgtatatatgaaaagattatatatgtacataacagggttactaacactcatgggttgtatctccgattatgagcctgatattgtgaaccaaataggtggtttgctggtagtggatggttttataactaatgatacgactcggatacgattgagccatagcgtaaggatgttggatgagtttgaggaaggggagtcgataacggatgcgaatgtttttgttgaatcagataaaggagctgtttttgaaacgttgaacgtgagtaaagatggagtttatacaataccgatgggagagttaaatcctgcgtataaatatagattatcaataaattggaataataaagaatataaatcggaatatttgaatcctctagatactccggtgatcgatagtatatctgttgaaagttcagcatcagaaactcctgtatatatctgcgtaactacacatgataacaaggtagagccaacttattataaatggacttatcaggagatatgggaattccatgtagatctatttgcaaacgctggttttttagatgataaattcactttatttcagaagcatacatctaaaaatacttattattgctggggacgtgatagttctaaggcgatgttattggaatcgacaaataaactgactgtaaatcttatctataagagaaaattgatagagatcccccgtgatcatgataaattgacaatgctttattatatagacgttaagcaaaaccgtatacgtaaagaagcgtatgactattttgtgaatttacaaaggaacatagaacaggctgggagtattttctctccaattccttcggaaagaagaggtaatatatcttgcgtatcagatcctaaagaatgggtgataggctatgtggatgtaactaatacaacgattatgaaacgctttatgccggaactaagagatttctatgaaacttcttatgactgtgcgaaaaatatcttaacaggaatagcaccagatggttatacctattacatttatagtggatcaccaaccactccaaatatttatgctccttttcgctgtgtagactgtacccatgatgggcgaggtaccaagaataaaccttcttggtggcctacggatcattattgattattgaggtggatatatgcttgggattaggtataaaagatatatattcgatcaaaatttaccgatggctttttagaagcgggtttatggaaaatacctatatttgtaaaaacgtataattgagaatcggtatgaatagtgatatattgagggataaggcggaatatctgatgtcgcttatcagtcattttgccgagcggaatgggctaagtataccacaggtctatcgttatgtcaaacgatatggtggcatatgtttggttgacgagcattatgacattatgcatacgttgagattcatcgatgcgttggaatcaatgactatgtacatgaaacgccaaggaggggctgtgggatgattaatttatttttattatggcagatgatattttgaatttagccacatcggaagaactattgtataatgatgtatgtggcattatagatggagtacgtgctaaagtagctacctatttgaatactgagatatgtatgacgaattggtatgtaggcaaacgtattaaggaagatatactatacaatcagcgtgccgaatatggtaaacaagtcatcaaaaaattggctacccggctaactgtaaaatatggaagcggatggggatatggtaaactcaaacattgtgtacgcagtgcgtatcttttttcagaagacgagattggatatgcggtgcgtagcccaattgacttggactcatcttcgttcgcttatgggagtaaaagatgagctagctcgctcgttctatgtggaaatgtgcagaatggagcattgggatactcgcacacttgatgaaaaaatagattgtcaactttatgagcgtacagccattagccgtaaacccgaagatatgatacgcaaagagctgaacgagataaaggaaaacaaccagctattgcccgaccttatatttcgcagcagttactttcttgatatgcttgggcttcctgatatattctcggagaaagatctcgaaatggcaattctttcccaaatacagcttttcattaaggaaatggggacagattttgctttccttgaccgtcaaaagcggattaccgtagatgcggttgattactatattgatttgctgttcttccatcgtggcttaaagcgtctgatagcgatcgatctcaaattggggaagttcaagcccgaatacgaagggcaaatgttactatatcttcgctatttgaacaagaacgagcgaaaagaaggtgaagaatctccaatcgggttaattctttgttcggaaggcaatacagagcatatcgaatatctaatgcttgacgaagatagtccgataaaggtagcgcaatattacacaaaactacccgataagaaagtgctttccgaaaaattgaggcgagcgatatcaatcgcaagggaacattattccgaattacgacaaacgaaagatatatgacactattttaccgggtacgtaactcgtgcccggtaaaagaacttaatctttgatattcccatttcccctaatatccccagtacttcaagaggcaccccgcgcaccccgctatgaggagggtgtagccggagatacccagccagtccgccccggggggcggtggggcggaggggggccgtcgtggcggaagagcgtcagcgaggcgccgatcgccgccagcgtcacctccgtctcccgcatgaggagggagaggagggctagcaggagaaggagcagcgccggtagcgtctgtcgtttcgggaacagggggatgctgcgggaagatgacccggaggagtgccgtgaggcaacggaggatgagttcaaggtatttcattttagttgacagttgatgataggggcggcatttgtccgccctttggattgacgattgatatttgcgagctgatttttcggcaaagctggacgatcagcttacgataggcttcccggttatcgccgttcacctcgctgatgtaggggctgtaggcgatctccttggcgaaggccgtagggttggcgctcatgtcggccgcccggggataggccgagcgaagcaggcggcagtaatccatgaacgagcacttatcgtccgggtagatccggaaacgtagcgagcggggcgacagctccgtccaccggccggtccaccatacgttgggcagcccgtaggccgtgatgccgaaaaagttatgatactcccggcagagcgtactctcgccccaacccgtctcgatggccgcctgcgccaagatcaccactggatcgatccggaacgcccgcccggcctctccagccagcggagcgtattcacgtataaaaacagaaatctccataccacttaattttcaattttcaattctcaattttcaattccctaaatctcgtccgggctctcggaatcgcccccgccacctcccggggtcacctctccgttcgagtactcggtgtactcacggagcttggccgtcagcttgagcgaggcgctggagaggttgcccgtggcacgggcacggaggcgtacgccggtgatattgccttgcgtggagaaatcctccggcgtgacggcccccttcgagcggatgcccacgctgaagatgccgaggtcgtctatcttcacgttcttgccgtccatcagcagctccttgatacaattcaccatgtccttcagcatgccgtggatggcgccggtggagaagggggtgttgtgggtggacatgtgctcggccaaggcggcgatgtctaccgtctcctcgcatacggcacgggcgtaccacttgttgaaggttgtcacgttcttctcgttcttgttttgatacttcttgtagcggatcataatgtgttgttttttaatgttgatacaaagatacggcagggcgtgagggctttgtcgctttgggtgacttagggtgatttcgggtgaattatttctccgggaaatgatggatatatgccggagattcactatctttaggatatggaaacgacattcaagatacgagcatacgggcggatggagctggccgaggtctacctgcccgacctgcatccccgctcggcccaccgcaagctgcaacattggataacgatctatcccggcctgcccggtcgcctcctctcgctgggttatcacgagggcgagcgggtctattcgcccgccatggtgcgggccatcatcgagtcgctcggcgagccgtgagagccggatggtatccgggtggaataggggcgctaagtcaatggaacgcaagacggattccattgacttagcgaccgtatctcattggttttcgagccgtgtctcaataaaaagcgcatggaaattgtataccccagtaaaatacagtagatttgtatattataaaaaggatggaaaatgactatatttgatgaatataagacatatacaggagactcttcaatctctccctccttgctttgggagtatgacctgtcacattttgactggtggaaatcccggaagattgtggtacagcgtgtcattgaaagaggatggttgaaggatttttatgccgcattcaatttatatggaggtatagagggattccgggaaataataaaagaactcccaagcttatctccacgagacatgaattttgtttgtattgtctttaatcttgaaaaggaggaactaaaatgttacacacggaagttgtctcgggaaaaacacttgaactcctgaaaaagctggaagcggaaaatgcgatgacccgttttaatctggcgggaggaacttctttagccctgtatttaggacataggagaagtgtggatttagatcttttcactccgaaaccgtttgatgcggcggaattggagagatttcttatggataaatatggattccgtaccggctttatggagaggaacaccttgaaaggttccatagacggaataaagattgactgcattacccactcttatgagtatcttgaaaagccatatatcgagtacggtataagattgtacagcatgcaggatattattgccatgaagctctctgccatcgccgacgatgggtcacggctaaaggatttcatcgacatcgctttcctctccacccgtttccctttcaattccatgttgggaatgtatgagcgtaaatttccgggggcaaatgtcatcaggcccttcaaggccattacttattttgaggatatagatttcgatgaggatatcgttatgctgaatggcaaatacgattggagagcaattgagaggagattggttgatatgactagaaatcaagataaggtctttgattcgttcccatttcctctgaagggaaaaaggtcttgatttgtaatagaaaggatatccataactctttttgaggagctttatgagcttcgctgaaacatagcggggtgcgcaagggtgcgcatctttacgtgttttcctaaaacttttctggtaaatgtaaatttgtgtcacactgctgtgtgtgatacaaatttatttatttctaaaatgtttttccaaccactcttttttgcgcacccctgcgcaccccctgctttaaaatggaagtttaggattcgctgtattgttttggttatcagtatgattcttttcatcttccttcttcgttcccttttcttccggggtgctcaaaaaattgtcttttacctgttccggagtgatctctacgacctcaaataggcgttttccacgtattgtcgtgagcttaaaaccgtgttttttcagcaccttgctcaacgtaactatattagaacgtgtcggcgtgatacgtgtaaatacacttagtttcgtcataatatcgctcgccgtaagatactgtggcgtgtcgaaacgctccggtttgcggaaataggtgaagaataattcctcctcggggcttcgctggcggaaggtctcgttgttctcgttgatcttccggatgtcttcgccggagaaccagtatttctcgccccggcggaagagggcgagggcttgggcgtagatgtcggcgtgtcgcacgggcgactggtaatcgatccgtgtggcctcgaagcagaggaagcggcgagactcgttatcgtccggcagcgattgcaagtcgttcaccgtggcggcgaaggaggcgtggcgtatctgcgtctcggcatagtgtccgtacgggcggcgcaggtagatgacccctgtggaggtgagcgccttgaggcggttcagatcggcgtagctctggccggacatctcgtcgatgacgatcaagaggcagtccaccatcatctgcgggaaacccttgctatacggattgacattgcccgtgaaaagatagtcccgcaactcgggcggcacgaggttccgcagccacgaggtcttgcccagcccctgcccgccggccagcagcaggatggtatggttttccacgcctagctccatggagccggccacttgcgcgataagccagcgcttgaggcaaccccgccagaaggcgggccgggtggtgtccacggtatcggccagctgcccgatccagtccgtcaccccgtcccacggggccagcccctcgaaatacgtgcggaaagggtggaacgtctcgctgaagtccgacatcagtatggcccggatgtcgttatgcgagcagtagtggccgtccttcaggaaactccgccagagcgagttcacccagtagtcggtcaccggcttgaagaccggcttttgaccgttccgctttttcttcgaggccacctccacgtaccccctcacgccgttcttgcgggtgaggaaacgctcggatatataggcctccacggcgaccacgtccagcgggcccccgccctttttccgggaggtggcggcgctcgtctcggcggcgtgctcctccacatggctgtaggcactctcgatggcggcgaggcgctcctccgccggcaagtcggcgaaggcggtagcggcgtaagcctccatctcggcccgcttcacgcccagccggttcgcccgtgcggccatgacgaagatgaagttattgcggttgccctcggcgtaggcgcctttccgctcggcggtccggcgtgccttctccagtggcgaggccaccttcctttccttcgccccgggagccgtctcgctaacctcctccttccaagtaaggggtagcggggcgaggccctccggtagctcgccggtaccctccagccaagggcggtaggcaggcgagaagtatagggcgggatcgtccgatacgaagcaaagccgcccgatgtcgctgcccgaggtatccagctccacgccgagccgggcggcgtaccaacggctcatggcctcgtagaccctccggtgattacccggcgtggcggtctcgtccgtggcggcgtaggcgatgagtttcgccccgtcgccgctgggactgcggaaatacgccacggtgtagggcgcttccgtggcgagcggggtgatacgctccagctcccgttcccctacgtggtcgatgtcgagtaccaccaattggttatagcgggtgatgtgagggtcgaggcgtttcccggagtaggtggcctgtggggtgaaagcgggcagttttttctttagtttggcggccagttccttatcgcccgacgctagcgcctcccgcgtctcgtcgatgaactgcttgtacgttcctctttggatgttttccagtacgcccgctagcgaggcgtctcccttgtatcgtccgaaaagggcgaataatgacgtgtttatcatactatatttttaagtgataaaaaaagagccagtgtctctggcttgatgccgctaaggtagggaggcgctttgggacgcctcccaagttttaacttttgttgtgaaaaacgggaagcttgttattcatgcgctttcccgtattcctcctgcgccgtcgagaggatgctccggaaactccttggctccgggcagccgttggggtgtatctcgaacacctcgtccagcgcccgtatcatggcttcccggttcgtctgcccgttcacccggaaacgttggtcatcgaggatgggcagcgtcagccgcacgaagtctttcacagagcccgtgtagatgatcttctcccgtttaaccagatcctcctccggctggtagtctttaaacaacttatgcgcccctttcgcgtcttttttcaagtccacccatgccttttgggcattttccaaactatccagcagctttctcacgcttgtttccgcttcccggaaactgattttttttcatatatgattaattgttaaagttaaaaacgtcgcaaaggtacattatctgcgtgataattcctcggaagttgttgctttgccggatatatatgcttatatttgtaattactcataaaaacaaagatcattatgacaataaagaagattccttacggagtgacggattttgagatgattcgtaaagaggattattattttgtggacaagactcgttatgtagaggtgttggaaaaaacggcccgtttcttcttcttgatccgcccgaggcgtttcggaaaatctttgtttatcaacatgcttagatggtattatgatatctataggcgggatcgtttcaaggaaatcttcgaggggctgtatatcggttcgcatcctacggcggagcaagggaaataccttgtgctcgattttaatttcgccggcgtgaatccggacccggatcgattgctggcctcgttcaatgataattgctcgatgcgtttcgatcttttcgccgggctttacggacatatgttcaatcccggtttcgccagtgaattgaaaagactcaagaacgcggacgagaaattgaactacctgatcgggcaggctacgttactggatcttccgatctacctgttcatcgatgagtatgataatttcacgaacgccatactcgccaatgtggggaatgagcattaccgtaaattgacacatggcacggggttcttccgctatttctttaataagctgaaagaaggtgccacgggaaacggaccgatcaagcgtatgttcatcacgggagtctctccggtcaccatggatgacgtgacaagtggattcaatatcggtgccaatatgagcaccgatccccggtttaacgggattatcgggtttagcgagcgggaggtacgtgatatgttgtcttattataaaggcgtggatatgctggccggagaggtagatgaggtgatcggcgtgatgaagccatggtatgataattactgtttctcaagagaatcgctccacgagccgatgtataactcggatatggtactgtatttcctgaatcattatcttccgttgaaaaaagttccggagaacatgatcgataacaacatccgtacggattataataagctccgtcatttgattcgcttggacaagaaaatgggcatgaacgcctctatcatccaagacatcgtgacgaatggcgagaccataggtaccatcaagacggctttccccgccgaggatctggcaaaaccggataattttaagagcctgctctattatttcgggctgcttaccatacggggtactaaatgggggagtaccctattggcgatccctaacttgacggttcgtgagcagttgtactcctatttagtggaggcttaccggagcgccgatttattttccctcgagatggatcggctggggatgctcgtggctagcatggcctacgagggaaactggaaacctgtctttgagtacttcgcctctgaattgaagcgacaaagctctatccgtgagtttatcgagggtgaggcgcacgtaaagggctttttgttggcttacttgggcttgacccgtacttatataattcatccggagtatgaggcgaataagggatatgcggacttctacatgatgcccgatttgttgcatcaaccggaaatcgtctatagttatatcgtagaggtaaaatatgcccgtcgtgacgcctccgccccggagatagaatcgctgaggactgaggctgccgggcaattgaaacgttatgccgaagatcctaaagtgagagagacgaagggaaatacgaaacttcgcttgataacactgatatttaaaggctgggatttggtggcttgtgattgaatgcctatatttggcatgaaactttaaatctgtatcttatgagaaagcttctggggtttttatgcgtatgcgcgttggctatcgctacggctagggcacaagatgcggtggatgactatgtctcttccgccgccggccaatccgtgatctaccatgggaaggagcaattaaaatatcccacctcgataagaaatcacccctatttgaagagcgagaaatacgtacccggggatcttagcttcgaaggcattctctacaaggacgtgaaaatgcgcttagacctgtacaagaatgagttattactgctctctccggacaatcgctataatatcgtcttgccgagcgatcgggtagactacgctgagtttcatgggtacgatatcttctacaggtatccggacgagcggtcgggcaacttgccggaaggttattacctacggttgtatgaagggaagtgtaccgtgctggggaaatggtcttgtatattatctaagacgataaaagatatgaagctcgatgaatccttcgatcagtccgtaaaatactacatccggaaggagggcgtttattataccgtgaggagcaaaggctccgtgttgaaggtcctcaagtccaagaaaaaagagctggcccggtatatcaagcggcgaaagctggatttcaagcacgctcccgaggaagccatcgtagccgtggtgagacagtatgaacagttaaacgagatcccatgagaaagagcctatatatcggtatggtaatgtgcctgctgtccggctggacggcgagggcgcagcggacggtcgatctggatttccggcaagtaaccttaaatgtcgtgttcgacgctatcgagcggcagaccggacagcccgtctaccggcaacccttggagacggactccatggtcgttagcgtacacagtgagaaggaagagcccttggtggcgttgcggcatgcgttggaggggactcccttccaagtatcctcgtatggcggcgccttctttgtattgagagataacaccttgatgacctccctgcccgagaacttcttcctgcgggagaagcggagagagggcgatggcgacgaggaaggctccggtatctccctgatggcgggccggaagcagcagaaggctacctcggagaacaaggtctacgagatcggcgacgcctcgggcaaggcggcggaccgggtcacggtgaccggcaatatcagcgatttcaagaccggtgagccgatggtgggcgtggccgtgttcgtgaaggacccgatgatcggggctactaccgacgcttatggctattatacgctgcgcctccctcccggacgacacgagctgtacatacaaggcatgggcatgaaggatacccggcggcagatcatgctccattccgacggcaagctggatatagagctggaggaacaggtctacaccttgaaggaggtcacgatctcctccgagaagatcgccaacgtgcggaatacgacgatgggagtggaacgcttgaaggtgaaggatataaagaatatcccgatggcgttcggcgaggtggatatcatgaaggtagtcatgtcgctccccggcgtgaaggcggtgggcgaggcctctagcggctttaacgtgaggggtggggcgacggaccagaacttaatcctcttcaacgacgggacggtctataacccgacccacctgttcggcttcttctccgtcttcaaccccgacgtggtgaaggatatggagctgtacaagagcagcatccccgccaagtatggcggacgtatctcctccgtgctcgacatcaacagccgggagggtaacaagaaggagttcaagggatcggcgagcatcggcttgctgaccagccgccttaccttggaggggcctctcttctccgagaagacctcctttatcgtgggtggacgtaccacttactcggactggatcttgaagaaactccccgagaagagcggctataaggatggcaacgccggtttttacgacctgaacgccacgattaaccataagttcgacgagcggaacaacctctatctgaatggctactatagccacgaccgtttccgctttaacgtggatgagcggtatgcctacgagaacgccaacgcctcggtgaaatggaggcatatcttctcggatcgtttcacgggggtcctcactgccggctacgaccattatggctacaatacccgtaatacggataacccggtgaacgcttattccctcgctttccgtatcgaccagatgtacgggaagatggacttcacgcattacctgagcgataagcatacgctggatttcggcgccagctcgttgttctacggcttggagccggggaaatacctaccctatggtggggagtcgttggtgaaggaggaccggatggagaaggagaaagcggtggagtccgctatctatgtgggcgatcgttgggatatcacctcccaactctccttgaacgtgggggtccgttattccatgtttaacgtattggggccccgtacctataatctctatgccgacgaccaactgccttccttggctaccgtgacgggtacggtggataagaccggggcgttcaagacttaccacgggccggagttccgggtatccgcccgttatgcctttaccgaggacttctccgtgaaggccggctttaatacgatgcggcagaatatccataagctatccaacacgaccatcatgtcgcccacagatacgtggaagctgagcgacgccaacatcaagccgcagacgggtatgcaagtggccgccgggctataccggaatttcttgaacaatacgatcgaggtctccttggagggatattacaagacgatgaaggattacctagattaccggaacggcgccgagctgctgatgaaccaccacatcgagacggacgtgctgaggaccgaggggcgtgcctatggcgtggagctgatggtgaagaaaacgcaagggaagttgaacggctgggtaagctatacctactctcgcacgcaactgcggcagaacgacccgatgatcgtcactcccgtgaacaagggggattggtacgccgccgatttcgataagccgcacgacttgaagttcgtgggtaactataagttcacgcatcgtttcagcttctcgctgaattgcgactatagcacgggacggccgatcaccttgccggtctccaaatatcattacgggggcggggagtttgtctactattcggaccgtaatcaataccgcatcccggactttttccggatggacgcctcgttcaacatcgagccgagccaccacctgacgttgctcacgcatagcacgatctctttcggagtctataacctgacggggcgaaagaacgcctactcggtgtattatatatcggagaacgggaaattaaagggatataagatggcgatattcggggtgcctatcccgtttgtctcttataatattaaattttaggggggagttgagatgaggaaagaagcgaagataaaagattctataaaaggctttcattggtggctgggggctttgctgttgttattgtccgcctgtgtcacggattacgagccgaagggtttggagcaggtacgggatttgttggtcgtggatggtatcatcacgaatggcgagactacgataaagctccggagaagcgtgggcctgaccgacgatttcacggaggatgagttcgtgaataacgccaaggtggtggtggagcgtgaggatggagctgttttcacttgcgctaattcttccgggaagggagagtataaggtggatatgggagagctggacccgggtagccggtaccggctacatatctcgctggatgggctggagtatgagtcggactatctgggaccggagataacgcctccgatcgactctctctccttgctgaagaaggggccgggagaggaggtccgtctctgtgtgtctacgcataatgccccggatcgatcctcttatttccgctggatgtataaggagaattgggaggtgaaggcggagatcttcatggctgccgagaaaatgggtaatacggtcgtaatatatgatttacttacatcgaataattggtattattgctgggggaaggacagctcgaaggtgatctccctaggcagttccgataggctgacgcagaacgtgatcgctaacaaaagtatcgcctcgtatcatcccagcgatcgccgtttctcgatgttgtatcatgcggaggtggaacaatatgcgttgcaccgggaggcttacgactactattttaatttgcagaagaacatagaggagtctggtagcttgtttgcccctattccttcggagatgaaagggaatatccgttgcgtgacggacccggaggttccggtgatcggtttcgtggaagtagcgacagtgactcgcctcaagcgtttctttccggagatagagaaggtatatgaggccgaggttacgggctgcgcaagcacgatcgtacagggatcggaatatgataataatccggattatggatatgtttcctataatccgatgaatgcggcgagtaatacgtatgcgctgaaacgttgtatggattgcggccgttttggttcgaaacagaagccctcttggtggcctaccagtcatttataatttagttgctatgaagaagtctatgataaaacaatggttcttgtcgctcctctgcctcttatgggcggggcaaacggttctcgcaggggaattgcgagagcgggtttacctgcaaacggataagcaattttatctgtcgggcgagcttgtatggatgaaattcattgccacggatttggaccaacggttgtccgacgtgagcaaggtcgggtatgtggagcttctggatagcgcctcggcggtcgtgcaagcccgactcgtgctggagaagggggtagggaatggttgcctgcaattgccttctaccttgccgaccggaaactaccggctggttgcctatacccgttatatgcggaacgagggggaggaggtcttctttgagaagccgctggcggtggtgaacaccttcgtgacgaacgagaccctgctgacggatactttattgcccgcttactcttttacgaggcgagagggcccggtttccgtatcaccggaccgtatgacctatgatacccgttcagggggggagatccggataaacggcctgcccccggatctacagaccctatcggtctctatcgccgggatcgacttgtataaaccttccgcccggagcggtatcgttgattggaaacaaagcatgcctactacgggatcatcgcctgccgatcgtaaattcttggcggaatacgaggggccgatcctgacggggaaagtgatcgatctgtctacgggcgaaccttcgtctaaagaggcggtgaggcctttattgggcttttccgggggggagatccgccttttcggggggcaactgggcgctgccggggaggtgactttctttacgaaacatatatctgggacgcacgagatcgtgacggtggctttatccccttcctcctctcgctaccgggtggacatcgaatctccttacgctacgcatccggagaaggagcttcccgccttgagattgaatcccgcttggcaagatgagttggtgaagcggagcgtggggctacaggtgttgcatgcttaccggtctgattccttggttcgggaaaaagcggagaagccttggttccagtggcaaccggattggagttatcttttggatgagtacacccgtttcacgacgatggaggaagtcgttatcgagtttatccccggccttcgtttccgtaagatggatggggttcgccggttggcggtcctgaccgaggagcggatcgggtatacgatcggtaactcattggttttattggatggtatccccatcaccgatcacgagatcatttttaagtacgatcccctaaaaatccggaagatcgatgtgtataaaggtaagtacgtattcggtgggcagatattcgacggtatcgcctccttctcctcttatgagcataattacccgggtctggtagtcgataactccacccagttctttgattatgagggcacgcaagcccagcgcatcttctatatgcccgcttaccggacagaggccgagaagcgatctcctgttccggatttccgccataccttactttggcgacccgatatccggacagccggcgagtcctctatatccatcccctttaccacctccgacctgaccggtgatttcaccatcaccatcgaaggcctgacccaaaccggcgaggccctctacgcgacggaacaatttcaggtaaaatagcgtgcgatatggattattctatttatctttgtaaccttactatgggaaattaaatcggattgaagattatgggaacattggaattgaaattatcattgatacaacggctcagtctcataaatgatgatgatttgttacatcgtatcaagagcttgattgataggatggaggaaaggcaagcccttcgcttctcgccggaagtaaaggttgccataaagcatgcgcgagaagatatctcggaggggcgttttattgaagatgaaggactggatagatatatggagcgatgggtaaacgaaagttgatttggtctcaatcagctttgaatgatatgaccgaaatttttgactattataataaacgtaataagagtaaaacgtacagcactaaattattaggagagtttagggcgataatgcgtttaatcctttcttctcctcgtatggggatcaagacagaggatgagaatatccgttatgtgctatctggtaactatgccttattttatgaaatcaagtcttgtacaatagaggtcttgattgtttgggattgcagacaaagtcccgggcggttggagatgtgcatccgtcaacgtcgttgatatgaaataaaaacaattcaagatatcctcattctcatcttaaatccgtacttttggcgaaaaatcagatttgaagatgagaagtttcgctagtgacaacaattccggcgtgcatccccgggtaatggatgcgatcatcaaggcaaatgataatcatgcggttggatatggtgatgatccttggacagaggccgctacgagtaagatacaagaagtgttcggcaaggatgcttctccttttttcgtgtttaacgggacgggggcgaactccgtggccctgcaagccgtgacccgtccgtttaatagcatcctgtgcgccgagaccgcccatatcaacgtagacgaatgtggagcccccgcacggatgaccggttgcgccatcgttacgatctctacgacggacggtaagctgacaccggaattgatccgtccccatctgaagaacttcggggtttgccaccattcgcaacccaaggccgtttatatctcccaagtatcggaattaggtacgatctatacgatagaggaagtgaaagcgatcgccgatctcttacattcgtacgatatgtatctgcatatggacggagcacgcttggcgaacgcctgcgcttacctgaattgcacgatgcgccaagtgaccgtagacgcaggcgtggatatcttgagcttcggaggcacgaaaaacggtatgatgatgggagaggccgtggtatcgttccgcccggagatcacggagaacctgcgattttaccggaagcaatccgcccagctagcctcgaagctacgttatctctccgcccagttcatcccttatctggaaaataacctctggttggagaacgccatgaaagcgaatatcagcgccgccaagctagcggacgtgctacgacagtacccggagattcattttacgcagaagatcgagtccaaccagctcttcttcacgatccctgccgaggcgttgaggaagttgcaagataaatatttcttctatatgtggaacgaggagatcaacgaggcccgtctcgttacctcttgggatacttccggcgaggatatcgctgagttcgagcagtcattgaaagagatattcggttaaggtatagatataaaatgaatataaacattagatcgaatcctatgaggaaatggtttatttgggcgatcgtcctgatcggatgcttgcccataaataaggcattggcacagcaaagcggcgatgccgagcggaatacgttgcgtatcatgagctataatatccgcaacggaaggggcatggatgaggtgacggacctccagcgtatagcggaggctatacgtaaggtagcccccgatgtagtcgccgtacaggaggtagatagcgtgaccggaagaagcggcgggatcgacgtgctccggacgttgggagaacgcaccctgatgttccctacctacgccccggccatcgacttcgatggcggtaaatacggagtaggtatgctgagcaaggagaagccggtgagctaccgctatatagcccttcccggacgggaggaggaacgggtcttgctatgggtcgagttcgagagatatatcttctgctgcacgcacctttccttgacgccggaagaccggatgctctccttgccgatccttcggcgggaagccgcttctgcgcataaacccctgtttatcgccggggattggaacgctacggctcattctccctttatcacggaaatcagcaaggatttccagttgttgagcaatcctaaacaggctacattcccggcttccacgccggatagctgcttggactatatagcgggttatgtaaagaatggacagccctttacccgtttgtccgcatgggttcccgaagaggcggtggcatcggatcatcgcccggtcgtaacggaggttcgcctgaaggccaagccggaagagatcttttatgcggcaccctatctccaaaatcctacggagggcggcataacggtgatgtggcagacccatgtccctacgtatagttgggtagaatacggtacggacacgctgaatttgaagaaggcccgcaccatcgtggacggtcaagtgatatgcaacggcttgcataacaagattcggctgacggacctacgaccggggcaaacctattactaccgggtatgctcgcaggaaatcatgctttaccaagcctataagaaagagtttggcgagacggcggtatccccgttctacaccttcacgctcccttccgcatcccaaaaggatttcacggccttgatctttaacgacctgcataagcatatcccgaccctagacgccttatacgggcaagtgcgtgatatcccttatgatttcgtggtatttaacggggattgtatagacgatcccgccaatgagaaagaagctttgtatcatttggcttatttatgcgggaaggtgggcgccagtcatgtacccgctttcttcctaagaggcaaccacgagatacgcaacgcttactcgatcggcctgcgtgccttgtttgactatgtgggcgataagacatatggggcgttcaactggggagatacccgtttcgtcatgctggattgcggcgaggataaaccggatagcacatgggtgtattatggcctgaacgatttcaccggtctccggaaagatcaagtgaatttcctctcgaaagaattgagcggcaaggagtttaagcaagcctcgaagcgggttttattgaaccatatccctatctacggaaacggggatgcctatgagccttgtccggagctttggggaagcctgttggcgaaagcccctttcaacgtgaatatatccgcccatacgcatcaatacgccttccacccgaaaggctcgttgggaaacaacttcccggtgatcgtaggcgggggttataagctcgattcggctacggtgatggtattgcggaagaaaggagacgagatgagtgtacgagtgttgaacgcaaaaggggagaccttattagacttgaaactataagagacaggatgaatacggatttgatttacgggatcgatgaccgtccgcctttgaaagagacgttttttgccgccatccagcatctactggctattttcgtggcgatcataacacctcccttgattatcgccggggcgctgaaactggatctggagacgaccggtttcttggtttccatggccctattcgcctccggggtatccacattcgttcaatgtcgtaaattaggaccggtcggggcggggctgctatgtatccaaggaaccagcttctcgtttatcggcccgattatcacggctggtttggcgggagggcttccccttattttcggcgtttgtatcgccgcctctccggtagagatgatcgtgagccgtacttttaagtatctgcgctcggtgattactcccttggtatcgggtatcgtggtgttgctcatcggcttgagcttgatcaaggtaggagtggtcgcttgcggcggggggtatacggctatggataacggtacgttcggtagtttgcgtaatatcggagtagctgtgtgcgtcttgttgagtgtcttgttcttcaatcgttgtaagaacaagtacttgcggatgagttccatcgtgctagggttgtgtatcggttacgcgatcgctttcgccatggggatggtggatatggaggctgtctcctcgcaaaacctgagagggtttaatatcccggttcctttcaaatatggattggattttaatatctcttcattcgtggcgatcgcattgatctatctgatcacggcgatcgaggctacgggggatattacggccaactcgatgatatcgggaaaatcgatcgagggagaaggctacctgaggcgagtctccggtggggtgctggcggatggggtgaactcgtttatctccggaattttcaactctttcccgaactctatcttcgcccagaataacgggattatccagctgacgggagtcgccagccggtacgtagggtattatatagcgggtatgctgatcctgttgggtttattcccggttgtcggcgttatcttctccttgatgcccgatccggtgctgggaggggctaccctgctgatgttcggtacggtggcggcggcaggtatccgtattatcgccgcccaagatatcaaccggaaggccacgttggtgttggcggttagtttgtccttggggttgggggtggagctgatgccggatattctaggggccgctcctcaagtgatccgtggcattttctcttccggcataacgacgggtggcttgacggccattctggcgaatttatttatacgtgtaaaagaagatcaaacagaataacaaattatggaattattgaagcaacgcatcttgcaagacggccgctgttatcccggcggtatccttaaagtggatagttttatcaatcatcaaatggacccgatgttgatgtataagatcgccgaggaatttatccgtcgttttcaagatcgtaagataaacaagatcgtgaccatcgaggcgagcggtatcgccccggccattatggtgggttatatcatgcagttgccggtggtcttcgtaaagaagaagaaaccgaagacgatggagaacatgctctctaccgtggtccattccttcacgaaggatcgtgactatacggtatgtatcagcaataacttcttgactccggaggatcatatcctgtttatcgatgatttcttggcttacggaaacgccgccatgggaatggtcgagttggcggagcaatcgggagccgtgatcgagggtatgggttttattatcgagaaggcgtttcaagatggcgggaacctgctgcgtgaaaagggcatacgtgtggagagcctcgccattatcgataatctggatgattgtaagataacggttcgttaaaggaaaagatatggatgagagaataaaagaaaagttgattaaccgtgcgaagacgaatccttatgtgaattttctggggatcgacttcacggttatcgaggaaggtcgtgtagaggcgcatatgcccttgcatgacgagcagagacaatatagcggcgtgacgcatgggggtgtcttggctgctttggcggatacgatcgccggtttcgccgcctatacgatgaccccgctggagaaagacgtgctgacggcagagttgaaaatgtctttcttacgggccgcttggggtaatgagctgatcgccaagggtaccgtgatcaaggcgggacggaatatacatttttgtgagtgcgagatttattgcgacgataagttggtgagcaaatcttccggcaccttttgtgtggtccatccccaagtatagaaaagatgttacttatttatcaatatcatgaagacttcaaatgtaaaaagaatcctttgcggctgcctgttgttcgccgctacgtggccggtattcagccagcctgccacgaatccccgcctgatcatccgtgcggatgacatggggtcgttccgttccgccaatatagcgtgtatggaagggtataagaatggggtggagacctgtatagaggttatggttgtcacctcgtggttccccgaggccgcccggctgttgagggagaacccggggatagatgtcgggcttcacctgacgtttaccagcgaatgggataacgtgaaatggcgtccgctgacgcattgtcccagcttgaccgatagcaatggctatttcttgccgatgatgtctccgaattccgcctacccgggtctggccattctggagaatacatggagcttggccgagatcgagcaggaggctcgggcccagatagagatggccttgaagaacattccccagatcagccatatctccggccatatgggatcgaccggtttcgatccggaggtggtgaagttgatgcgccgcttgtccgaggaatatcatctgccggtcgtggatcgggtagaggcgatgcaggaatatgatttcacctattccggatatgacgggccctccaagaccccggccgagaaggaggccagttttatccggatgctggataagttggaacccggcaaacgctatatgttcttggatcacccggccttggataacgaggagatgaaaaccgtcgggcatatcggctacgagaacgtggcgatggaccgtcaaggcgtgaccgatctttttaccagtccgaaggtaaagcaagccttgaaggataagaacatagacttgatcagttataacgatctgaccaaggagcttcctcgtgcggaagcctcgaaaaccttggataaggcgttcggcaattatctgcgggcggtgaaaaaggcggatcaagacttgcatagtatcatgatcctccagcatggaaaggttgtaaaggagcaatggctgggtgagggcgaccgccatacgccgcatgtcttgaactccgttagcaagacctttacggctacggctatcggtttcgccgtcgcggagggtaaattgaaggtcacggacaaggtgatctccttcttccccgaccaattaccggccgaggtaagcccttacttgaaagagctggagatacgtcacctattgaccatgtcctccggccatgatgtcgatcccaccgctttagtacggcagaaggggaacgagaaggccgattgggcaaagctcttcctctcggcgccgttggtacataaaccgggaacctatttcgtatacaacagcctcggcacgtatatgctttccgctatcatccagaaggtgacgggggagaaggtgatcaattatctctatccccgcctgttccgtccgctgggtatcgtcggcgctacttgggaagagagtccccaaggcgtcaattgcggtggttggggtttgtatctcaagaccgaggatctagcgaaaatgggtcagtttttcctgcaaaagggaaaatggaacgataagcaattgcttcccgaaagctggatagaggaagccaccacctccaaaatagcctctttgcccgccggtatgagaccggagaacttgaagatgaaaccgaaagatagcgactggttgcaaggctacggttaccagatgtggcgttgccgccataacgccgttcgtgccgatggagccaatggacaatacattattatattgcccgagcaagatgcggtaatcgccatgactgcgaatatcggcgatatgcaggccgagatcaacttgatatggaaatatatcttgcctgccttgagataggaactgtaggacctacgtccgggaaaccaataagaggccccggacgtaagcctatgtgacttgttgggcgtaagcgaatggtttacggtatgtaagtcaatggattacgggaaaaactcaatgattcccaccccgtaaaccattgggttacaaaaaaagaaaagccttccggtctatgaccagaaggcttttttagttgcggaggcaagactcgaacttacgacctttgggttatgagcccaacgagctatcgcaaaaccactcgcacctgaaacgagcgcgtctaccaattccgccacctgggctttttttaatcattctgaagcgcaacctatcggtattgcgcatacaaaggtaatcgttttttccaattagcaagcaaatgaaaataaaaaaagcgaccgtcccttccggaacggccgcccatatcattaatcacgggagtcgattacatcataccgcccattccgccacccatacccgggttcatcggaggcatagccggagtctcttctttcttctctgcgatcacacactctgtagtcaagaacataccagcgatagaagcagcgttctccaatgctacacgagttaccttagccgggtcgatgacaccagcctcgcacaaattctcgaaacagtccttacgagcgttgtaaccgaagtcgcccttgccttccttcactttctgaacgataacggcaccttccttaccagcgttagctacgatctggcgaagcggctcctcgatagcgcgcttaacgatctcgatacctgtagtctcgtcctcgttgtcgcccttcatgccttccaatgcatcgatagcacggatataggctacaccaccaccgggcaccgtaccttcttcgatagcggcacgagttgcgtgcaatgcgtcatccacacggtctttcttctctttcatctcaacctcagaaggagcacctacgtaaagaacagctacaccgccggccatcttagccaaacgctcttgcaatttctctttatcgtaatcagatgtcgtgttctccatctggatcttgatctggccgatacgagcttggatagcctccttgtcaccagcaccatttacaatggtagtggtatctttgtctaccgtgatcttctcagcggtacctagcatatccattgtagcaccttccaatttcaaacctttctcctcagagataaccgtaccgcctgtcaatacagcgatatcttccaacatagccttacgacggtcgccgaagcccggagccttaacagcgcagatcttcaaggaaccacgcagacggttcactaccaatgtagccaaagcctcgctatcgatatcctcggcgatgatcaaaagaggacgtccgctctgtacggtcggctcaaggataggaagaaggtcttttaatacggagatcttcttgtcatagatcaagatatacggattctccatctggcactccatcttctctgtatccgttacgaagtacggagagatataaccgcggtcgaactgcataccctcaactacgtcaactgtagtttcagtacctttagcttcctcaaccgtgataacaccttcagtcttcacacgttgcatagcctccgcgatcaacttaccgatagcctcgtcaccatttgcggagatcttcgctacatgctcgatcttctcgaacttatcacctacagcctcagcttggttagcgatgctctctacaaccttagcgacagccttgtcgataccacgtttcaaatccatcgggttcgctccggcagtaacgttctttaaaccgacaccaatgatagactgagccaaaaccgtagctgtagtcgtaccgtcaccggcgttatcgtttgtcttggaagccacttccttaaccaattgagcacccatgttctcgaacgggcaagtcaactcaacttctttagcaaccgttacaccatctttcgtgatgtgaggagctccgaatttcttctcgataattacgttacgacctttcgggcctaatgttaccttaacggcattagccaactcatccacacctttcttcaaaaggtcgcgggcatccatatcgtatttaatctcttttgccatgattgtatttcttttttaatattgttgtttataaaaatgaattagataatagctaaaacgtctgcttggcgcatgatcaagtatttctcactgtctagttcgatttccgtacccgcatacttaccatacaatacgttatcaccaacctttacaaccatctcctcgtctttcgttccgttacctacggctacaatctcaccctttaaaggtttttcctttgctgagtcaggaataataattccacctaatgttttctcttccgcagcggccggcttaatcagcacgcggtctgctaatggtctaatgttcattttcttggtattttaaatgttaataatattacttttttagttatgaactttatgttcacgcctaagtctatgcgaatagtgtgccaaacgtattcacccgagttcgactgacaatatttcggacgaaatagacaaatatccgaagagataactgacaacttgtctttttgcatctctcaaaaagagaatcaatcgaccagcagcgtattcatggaatatgcttttacgatcggagtatagactcgatcgccgatgcgaatggaaagagaatgatcatcactggtctcattggcgataatcaaggcgatactgttatccgggttacggaatgccagcagattcgtataggctccttccgtttctaatttatacgcaccgggctggacataatggctgacatgtttcatcacgtagtattccggagtatatcgatagctcttggtttgcggatctacgacaaccaatgagttttgcgcccatccccaacgactgatccctccattttccaaagatatattccaatacatataggcagaaacgccattatccagaaaatgtcgcatcaacccccaagaatacatggcacccttccaatcgttcttgccatctccacattcttgctcggtttggtaaagcttcaacccgggataacgtttgtggattccggtgatagctcccttccccgcccattggaaaccgacaccttttacatatttaccactaacaggatctgtcaataccgtatcaacaagcgactcattcgctcgttccatcgtgccgaacataatttccactccttgatcctgtaaggtcggcccgagatagttaccgataaaattagccaaagaagccgatgtccaacaacaactcgggaatatttgcgcagagttgaactcgttctggggcattacggcaaagattggaattccttgtttcttataggcctcgataaatttagagaaatagagggcataggctttcaggtaaagagggtcttggataaacatatccgtaccttcatggccgaccttatcggccggcaagccatttcgatacttctcgtcataattctcacccgtataggcagaggcatagtgtttgttatatttcatccaagcgggagggcaccacggggaagcccacaagcgtaagtctggctgatacttttgggcgttcttgataaaagggatcaaggtttgttggtcattggcgatggtaaaatgttccatcgtgaaatcaccgtctacctcgtcatacgaataccaatcacgggagaaatcatttgctcctacaggcatccggcaaatcgtgaagttggctccgactccagggaagaaaagctcttccatgatttcctcacgtacacttggctccagcttactcaaggaaagccaacctaattcattaaaacaggctccgaaaccatcaatttgttgttgatgcttttctgttagaattgttatatcaatattaggtatcgtatccgcaagggcggagatcagatcgggttgctcagcccaaggggtattctcggttgttgttacccactcggcacggggggtgaaagagcaggaagaaaagtataaagatattgagagtataaaaacaggtattttcatggtcgtttcattaatttataagtttagaaccatttaaacacggactacacggatgacacggaacacacggataaatactaataccgtgtgttccgtgtcatccgtgtagtccgtgttccataatccactattctctaaaagcgttctatcagctcctcgatagtcacaaggttttgctcacccgtgagcatattctttaagttgattttattctcggccatctcattctctccgactatcgcaacaaacgggattttcttagcgtccgcatatcccatttgctttttcattttagtagactcaggatatagctccgtacgaatccccgccttgcgaaccttagcgatcaacggcaataaatgaatctcctctttctgtccgaagttcacgaatagaagctgtgtagtcttcaaagacccttccggatataaatccaattggttcaatacatcaaagatacgatcagcgccgaaagagaaaccgacaccagatacgccttccatgccaaatacccctgtcaggttgtcatagcgaccaccacctgtgatactaccgatctgtacgtccaaggctttcacctcgaaaatcgcacctgtataatagtttaagccacgagccaatgtcagatcaagctctaattccgcacggattggcgtatgagagatgcgctccaagataaaatccaattcggctacacctttcaaaccagtctcagacgcagataatacctctttcaaggtagcgatcttttcttgatttgaaccctgcagcataatgatcggctgcaaacgctcgatcgcctcctcgggtaaacccttggaacgaagctcttcattcacgttgtccaagccaatcttatccagcttgtcgatagctaccgtaatgtctacgatcttatccgcctcgcctatgatttcggcaataccggaaaggatcttacgattgttcatcttgatacacacacgaatgccaaagcgatggaacacctcgtccataatctggatcagctccacctcattgatcaaggaatcagaacccacaacgtcgccatcacattggtagaactcccggtaacgtcccttttgcggacgatctgcacgccaaaccggttggatctggtaacgtttgaacggaaaactgatctcattacgatgttgtaccacgtaacgagcgaacggaacggtcaaatcataacgcaagcctttctcacaagccttagcagcaaatctcaacgggttcttttccattaactcctcatttgagatgcccgcgaaacaatctccggaattcaatatcttgaaaaggagcttatccccttcctcaccatatttccccatcaatgtagaaaggttttccatggcaggagtctctatttgctggaagccatacaagtgaaatacttcacggatcgtgttgaatatataattacgtttcgccatttcctccggcgaaaaatcccgggtacctttgggtatggaaggtttttgcatgatcttatgttttaaatgattattctgtccgcaaaggtaatgtttttgctcgaaataaataagaaaataacaatgcccactgtaaggagcttacaatcgcagttataagcatcttacaatgggcattctaacatctttataatgggcattcgaggaaagcctcctccgagacttatcaatccctgcttcttccccccaagaatatcattatataatataataatgtagcaagcgaacctaacgctgcgaccacgtacgtataagcggcggaacgtaaagcgtcctctgccttatcatgcgtataagcatttgttataccggcattgctcaaccacgctaaagcacgttggctagcattgatctcgaccggaagcgtgataaagctaaatagcgtagtcgtagcgaacaagattataccgaataacaatagctgaggaaacgtatgcaataataacataccacccaacaacacccatgtcatgatattagaggcgaaactaacaaccggaaccaaagccgaacgcattctcaacggagcgtaagcggtagcatgctgcacagcgtgaccgcactcatgggcggcaaccgcagcggcggcgatactattgctataataaaccgactcactcaagttcaccgtctggttagcgggattgtaatggtccgtcagatgtccgggtgtagaaatcacctttacatcatagataccattgtcatgcaacatcttctcagcgacatcttttcctgtcatgccattcggcatagggattttcgaatacttctcaaacttgccctgaaggcgggatgacaccagccaactcaatagcgcaaatccaataaatataatccaatacatactcataaatttctatcttatttagttttataaaacaacgacaaaaagtttgccaaagacaaaaatggcaggagacaccccttgaggaatgtggtcttctgccattttgtacgatttataacgagtttattcttctgtatatctgacaatcgtctgttcacgatccggtcctacggaaacgatcttcacaggcacacccagttcttcctccaagaaagaaaggtaagcgttgaactcctccgggaactcgtcctcgctctgcatcttcgtcatgtccgtcttccaacccggtaactccacgtatacaggttcgatcgtatcatcgatctcatacgggaactcattagtctcgacaccattcatcttataagccacgcaagccttgatcgtatcgaaggtatccaacacatcactcttcatcatgatcaattggcttacaccgttgatcatcacggcatatttcaaggctaccaaatcaatccagccacaacgacgtttacgtcccgtaaccgcaccgaactcatggcctaattgaccgatcttatctcccacctcatcaaacaactcggtcgggaacggaccactacctacacgtgtacaataagccttgaagattccatatacctcaccgatattccggggagaaacccccagtcccgtacaacatccggcacagatcgtgttagaggaagtcacgaatggataagaaccgaagtctatatccagcatcgtaccttgagcgccttccgccaagaccgacttaccttccttcaaatagttattgatgacatgctcgctatcaatcaatttgaattgtttgaggtagttcaaggcctccatccattgagcctccatctcggttatatcatattcatagttcaatgaacgcaagatcgcttcatgttttgctttagcggccgcatatttctcttcgaagttatgcaataaatcgcccacacgaacaccgttacggctaatcttatccgtataagtcgggccgataccctttcctgtcgtaccgatctttccggaaccttttgcggcctcataagcggcatccaagatccggtgagtaggtaaaattaggtgagctttcttagagatataaagctgcttggtgatatcgtgaccactcgctgccaatgattccgcttcctgcttgaacaataacgggtccagaacgacaccgttaccgattacgtttatttttccaccttggaaaataccggaaggaatcgaacgtaacacatacttttccccgttaaactccaatgtatgtccggcattagggcctccttgaaaacgagttaccacatcgtaattcggagtcagcacatcgacaaccttgcctttgccctcgtcgccccattgcaatcctaacaaaacgtctactttcatcttttctatatttattataggctattaatattcttatttaccagacctttgcaacttaaacttgcatttactgcacaggccataaatgtacaaacaataatactccggcgtaaaacgagagactttcaagtttctcatatccgctttcaacgcactgtttcgcagctcccgcatggccccgcatctcgtacaaaccaaatgcaaatgcgtatcggcataaatcctcaactcatattgcaccgactggacggttatttgatgacgcaccaccaaaccggcatcaaccagtacatccaacgtattatagagtgttgccttactgacatggaagttgtcttgctccaaccgatccgaaagcatacacacatcaaaatgaccgggaaaagcacatatctccttgaatatagcatatctctcctcggttttccgcagtttcttctccgttagatattcggtaaacaacgcacgtatttccgtataaactttcgcttccatctcctaaagaccgcacaaacgacaaagttagcgcatttattttaaacgcaaagccttaccgataatattcaaactcgaattttaattcattatagatttcttgtaattccggcgtgtttcccacagcctcctgaaattccttgaaaccgtctaggatcctttccgcattcccctcggattgacgcccataaaacttcatggcttgaatagacgcttgtttctctttcagcgtagacttaaaacccttagtctccgctaagctgcttaaggtttctaccaaaaaagatcctaaaaccacagaagacaagctaccacctcgcttgaaattctcggcccaagtaagaaaggcgaccgtgcgggcgaactcattttccttatcagcaaccagatcaaacgtgaagtcctccatataaggcagatgaacgaacaagttccggcaacaatgctccgcgatctctaaataaggaatctccttgacccaacgtttcgcctcatccaaaggcaacgtctcggcaggttggagaaatgtcgccaagatcttaaactcacgaatatcttctttccatagagccgccgccagttctccattcggtttatgcttgcgggcgatttcttttatttcggggtatggaaccccgaaatttaacttatatacgatacctttctcacgcatactcgtagaaatcaccccgttcatcgccaaacgaagttgcttgcggatctcccttatctcgtcttgtaaactttccatctattaattattataagtcggcaagaaagaataatcacagccataacgaagcatctgatctgtataaccttccgtgtagtccaagacaatatcagtaacctcaccgttagagttctttacctctttcatcacagggttgacaaaacctttatagggagccaagtttaacttagcatagcgctccaagacctccgcatgcagctccggatctactttcacgccgtatccttcaacaagattctttccggccgcatagtcaccctcactcttgatacgttgaatctcagcgagcaatgtcccaaacaactcacgtaacctcggatagtcattcacaaccacataggtctttccatcccgttttttcagttcgatcacattagcttccttccctttctcgtaagcccacttagcgatcaactgacggttacgcatatgcgcctcttctacattcttgcctagctcgatacgaaccaactgggtcatcaagccattcattatatatttatagtattccgatttataagcctcgccgtccggaagcaatcccagttccaccagcttcggatctgccaaataatacaggccaaacaaatccgcacgggtttcctccagtgtagagctataggctttcagcgcatccgggtccgtattttccagcaatttaccggaaccatgtcccagacactcatgtaaatccgtatgtagattatccgttaagaaaccgtactgcctcataccgttccgctccacgtcactccaaacaaactcttcgctaaagccatttccctgagatgccttatcataagcctccgtgatattctctatcgtaacagacttcgagccatgatctcgacgaatccaatccgcatttggcaaattgataccgatcggggtagccggatagcaatcacctcccaacatagataccgtgattaccttagcgctgactcctttcaccttctctttcttgaagcgcttatctaccggagaatgatcctcaaaccattgcgcattatcactgatgattttcgtacgcttagtcgcctccttattcgtaaaattcacggtagactcccagcttgctttcattcctaacggatccccataagtctcgataaagccattcacgaaatccacctccgaagctgtatcctctacccaaaggatcgaataagcatcgaacgtcttcaaatcgcccgtttgataatattcgatcaatttcccgatgatcgctttctgcgtatcattctcggcgaaaggcaaggcttgtcgcaattgatctacgattttttctattgcggcggaataaagccctcctactttccaaaccttttcaacgaccgtaccgttctcttttaccaaacggctattcaacccgtaagaaatcggggaaatggtatcctttcccattttcatttgcgcatagaagtcctctacctctttttgactgatgcctcccccgtaataattattagaagaagctttgatcagatcaccgtcaccgctttgtacgctacgctttggcataacgcccggatcaaagattaccggagcgatctcgatcatgaactgatccacgttttgattctcacgaagaggtaacttcttagcgtcgatttggtgaatacaatccatcaagaactcaggagaaaaccccggggcaaacttgtccaacgcataatgatgatggataccactggagaaccacacccgtttcaaataggtttccaaagccttgaattgagggtcctcccgatctcccttataattcgtataaatagcctccagtgtcctgcggatcgccagattatagcgtccattctgatcgaagaatatatcacgtcccatcaaggccgcttcggaaagatgatataatagttgcttttgtcgcaaggacagggattcgaaacccggaactttatagcgaagaatctccagatcagcgaactgatccactacataattgaactccttatcggaattttgagatgccgtatccgactgttggcctgtacaagccgtcataaccatagctgtcataagcgataacattatttttttcatatcttactacgatttgcttttcctataatatattacatctaaagtacatagtttgaaggcccgcattccaataagggccaaccgcaaagatagagaatatacagtcaatatcaaaggtttgagattttttctctacttttgtaagttcaaaagcaaagacaaaaaagagaatggaaatagcggcattagtttcaggaggagtagacagctctgtcgtagtgcatcaactcaaagaggcaggatacgatccgaccatcttctatatccgtatcggcatggaagacaaggatggctatatcgattgcccggcggaagaggatatcgagatcacctcatatatcgcccgcaagtatggatgccggttcgagatcgtctccctacacgacgagtattgggatcgggtggtaagctatacgatcgaatctgtcaaacgcggtcttacccctaacccggatatgatgtgtaataaatatatcaagttcggttgtttcgaggaaaaatggggcaaggatttcgataagatcgctaccggtcattatgccacgaccacggagatagacggcaagatatggctttctaccgccaaggacccggtaaaagatcagactgatttcttagggcaaatcacccgcctacagatacagaaactcatgtttccgatcgggcatttaatgaaaagtgaggtacgtgccatcgccgaggcccagaaattgccgagcgccaagcgtaaggatagccaaggcatttgcttcttaggcaagattaactacaacgactttatagagcgttatttaggaaaacgcccgggaaaaatcgtggaactagagacgggtaaggtcttaggtaaacacaatggatattggttccatacgatcggccaacgtaagggattgggattaagtggcggcccttggttcgttatccaaaaagacattaagcgaaatatcatttatgtctccaacggctacgacccggaaacgcaatatggtaaggtgatcaatatgcaaggcttcgatttcatcacggaagatccatggggagaatttgagggtgagaaagaaatcactttcaagatccgtcataccccggaatttacgcatggctacatccgtcgtatcggagatctatatcgtgtagaatccgacgaaaagattcaaggtatcgctcccggccaatactgtgtaatctacgacaaagaccatcatttatgtctgggcagcggcatgattatcgacgagacgaagtaacactccgatttatgttaaataaaacggtcgcctcaaaggaagcgaccgttttatttttctatcttattctattaattaaatagcatacaaagagctgatggactcaccactacatacacgacggatcgcctcagcgaacatgtcagcgacagataatacctttactttctcgcatttcttagcgtaaggaatagaatccgtaaagatcatttccgctaaagcggactgatctacacgagtagaagccggatcagacatcacagcgtggctggcgatagcacgaacagacttcgcgccattctccaacatcaagttcgcggctttcgtaattgttccggccgtatccaccatatcatcaaccaaaaggacatccaagcccgtcacatcaccgataatacgcatctcggccacctcattggcacgcaaacgagatttgtggcaaatgaccatcggcaagcctaaatacttagaatagctgctggcacgtttcgtaccaccaacatccggagtcgcgatacacaagttatccaaaggtaaagacgtcttgatatagtccaagaatacggaagaagcatataagtgatccaccggaacattgaaaaatccttggatctgatccgcatgaaggtccatcgtaatcaaacgattgatacctgccgtgctcaacatatcagcgatcaacttagcgccaatagaaacacgaggcttatcctttctatcctgacgagcccaaccgaagtaagggactacagcgatgattgaatgtgcggaagcacgtttagccgcatcaatcatcagaagcaactccatcagattgtctgaattagggaatgtagattgtactaagaatacatctctaccgcggatagactcttcataagaaacagagaactcaccatcggcaaagtgctggatattcatctgtcccagaggacaacctaaactgttgcaaattttctctgcaagataccgggagttcgttcccgaaaacaccaagaaaggagtttgtgcactcattattccgaatatttatcttaaagtgaatagatttgaattgtgccgcaaaagtacaaaacttatttacaataacctctttatatttggaaaactttctatatttgcaaccgcaatgatgaagtatttactctatttcttcgtattggtaagtgtatttctgacttcgggttcttcatcaactcccgagaaccaacagaaatacaaggatatttacaccatgtactctccgaatgaagacaagacggaatacaatatcccccaaacagatatcgaacgatacgaaaaaaagctatacaacggaaaacaaagctataagatggaagatggctatatcaaggcttcttcactattccgcagcacctccacatcaaaaaactcaaggacaaacctatcctcatccgcggaaaggatcgtacggtttataaaaactcaatatcctaaagaaagacaaacattcatttcattttgtataaatccccttaaattctcctatgggtactatatctataccctaagacgtattctcatttaaactctctttcccccttatttccatcaaaaaagtagaagatagcactttaatgtctgctttctcactattcttattttctagatttctcaaagggaacagaataaacatctattttgttttcttattgggttatataggatagttcttatcaattaataatcaatctaaaatggaatttttattagacttcatcttacatatcgatcagcatatgatcgagatcgtacaagaatatcatacttgggcctacgcgatattattcctaatcattttttgtgaaacgggattggtagccaccccattcttgcccggggattccctcttgttcgtcgccggagcgataacagcgttacccggtatgcctttagagataaatctcttagccttgatattattcgtggcggcagtattgggagactcctgtaattatatgataggtcattttttcggtcgtaaactatttaacaatcccaactccaagatattcaagaaaagccatttggacaaaacgcatgagttctacaaaaaatatggaggcaaaaccataatcatcgcccgattcgtaccgattgtccgtactttcgctccctttgtagccggaatgggtaaaatgcactattactatttcatgatctacaacctgataggcggcgctttctgggtactgcttttctgctatacgggatactttttcggagatcttcctttcgtacagcagaacctcaagatattgatcatagcaattatattcatatccatacttcctgccgtaatagaggtagtacgggcaaaactaaaagcacggaaacagagataacaaactttcattcaacaaccaagtatttaaaaacgatttaatatatacatgtatgaaaaattctttttttagtcgattcacccccaaagaacccaagttctttccactcttaaagcaattgtctgaaatattatccgcctcttccagcattctggtagaaagcttgcgacatgattctcctacggaaagagctaattattataagctaatcaaggataaggaacgggagggggacaaactgacccatctgatctttgatgaactaggaacgacatttataacccccttcgatcgggaagacattcacgacttagcctcatccatagatgatgttattgatggaataaacagttccgccaaacgtattaccatctataacccacgccccatctctgatagcggaaaagaattgagtttactcattcaacaagaggcgcactatatcagcaaagcgatggatgaactcgagacttttcgcaagaaaccgactacgttacgtgattactgtaccaagctacatgacatagaaaaccaagcggacgacgtatatgagctttttatcacgaagcttttcgaggaagaaaaagatagtatagagcttatcaaaatcaaagaaatcatgcatgagttggaaaagacaacggatgccgccgaacatgtcggtaaaatattaaggaacttgatcgtaaagtacgcataaaacagggctatattatggaattattagtgattatcatcattctgtctctgatattcgattatatcaatggctttcatgatgcggcaaattcgatagcgaccattgtatcgaccaaggtccttaccccttttcaggctgtaatatgggcagcattctttaatttcgtcgcatttttcatcgctaagtatataatcgggggattcggtatcgccaataccgtatcaaaaaccgtagtagagcagtatatcacattaccgattatcctgtccggggtaatcgccgctatcgcatggaacctgttcacttggtggaaaggcattccttcctcttcttcccacacccttatcggaggattcgccggagcggctatcatggcacacggctttgaagcgatccaattgaacattatcctaaaaatagcggctttcattttccttgctcccttcataggcatgattgtcgctttcgggtttaccttattagtgcttcatatgtgcaaaagagtgcaccctcatacggcagaggtatggttcaagaaactccaactcgtatcttccgccttattcagtatcgggcatggattgaatgattcccaaaaagtgatgggtattatcgccgcggccctaatcgcagcccactccgagggattgggaatggggataaatagtatttccgatttacccgactgggtagcgttctcttgtttcaccgctatctcacttggaaccatgtccggtggctggaaaatagtaaagacaatgggtactaaaatcacgaaggtaacccccttggaaggggttatcgctgagacagccggtgccttcactttgtaccttacggagtttctgaagatcccagtcagtaccacgcatacgattacaggggctattatcggagttggtacgaccaaacgtctttcagccgttcgttggggagtaactcaaagcttgatgaccgcatgggttcttacgatcccggtaagcgggcttttagcagctggcatttattatatggcttcccttcttttcatttaaatcaaagaaaaaagtcatctagcttcatcgggcaagtatgttaagttactttgccatttcacttaagttacttgcccgatgaagctagatgtcccgtatcaaccacctaactccaccaacgaattatctatacagcacacctaaacttttcaagaaagctcttatttatggagaaaagagaactttagcatcttaccggaataagcagggagtttcacttgataaggataagcgtctgttagcgtactgatagtcgtttccccggttaacaagtcggtcaattcagccggtttgttatcctcaaaatcaagagccttgaatgcctcgatcgggatatttacccatacacattgatcggcatggtcgaaattcacgaccaccagaagcacctcattcttccatttgcgcaagaacgcatactgacggttcggattgaaataaggattaccggagttcgcatacatcaaatcataaaacgctccctcgacaataaccggctcggatcgtaccacattcaataacttagcgtacatctcacgcaacgagcgttctgccggcgttaatttagctccgtcaaagtgtccattattattccagtttcgcaaactctcgacgctccaataatcgaagatggtcgtacggccatcacgtccgctgaaaccttccgcgtccattcctctttcgccaagttcctgaccgctatagatcataaccgggttcgtattcatggcagcggagacaatcatgcccggaatacccggacgagcatcccccgcaaagaaatcagaagcgacacgctgttcatcgtgattctccaagaaattcaacatatttttctggattccctccaacgattgccaacaatgcgatatattactagccggagcctgtccgcacatcaccgcacgaaccgtatcataaagaccaaccttgtcatacaaataatcaaagtgtcccgtataaatataattcctatactcatccggattatacacctccgctataaagatcacatcacgcaccttcttcacctgaggaatcacccagttccaaaactctaccgggaccatctcagccatatcacaacgaaaaccatccacccccttatcagcccagaacaacaagatctccaacattttctcccacgtattgggaatggtattgaaatggcaagcaccaccgtgcatataatccacgccgtagttcagcttcaccgtctcataccaatcgttctggcttggataggcatcgaaatgattgttaccggtcaccttcgccggaaactcactataggcaaaatcctcctcacgctgcggatcaaaacgaagcgtcaaggtctgtcccggaagataataaaagttattattcacatcaaaagccttggacacattatccgtttgacctaagtcctccacgaaaggttcccgtgcgtccgagaaatattgacgtgccacatggttgggtacaaaatcgataataaccttcatcccagcctcatgcgtacgtttcaccaaatcctcgaactcactcatacggttctggatattatccgccaaatccggatctatatcatagtaatcttttatagcatatggagatccggccttaccttttactacggcagaatggtctttccggatgccaaacatggtgtaatcggtttttgtagcgtgctctatcacccctgtataccatacatgagtaacacctagttctttgattttggataaagccaaaggagtaaaagccgaaaacttacccactccattctcggctaaactaccattcattacaggagatggtcgcagattcccaaaccaacgcgggaatacctgataaattaccatcttgtttttttgttccattgcgttcatctatatataaagtttttatgggaaagcgctttgtccatacagacgatttgtcacggcatcaggcctttctttcttgccgcgatcgctttcaccaaggtttcatatttattctcatccaacactttctcaaagcaacgggcagcggcggaatagccaatattacaaatcacgtctacattctcaagatcgaatgtcttatataagccaaactcctccgcctctattaagacatcacacatctctcgatcctccagcgtatttgcccggaacatataatgataagagcgctcggcgatatggaatatggtctgcttatatttttgcgggatcaacgggcttacgttcaccccgataatacgctcacattcctcacggatgatggagaccggaaagttgtgaaataatcctccatccacataatgaacgccattgatgactacaggactgaaaataatcgggatactacaagaagctgtcaccgcctcaacaataggaccactcctaaattcatggctttcgccattatccaaatcagtcgcgacaatcaccatcggaatctgcaagtcctcgatgttcttggtccgcaagtgtcgcctcaagaaataacgaaagcgcttactatcgaacaaacccgccttaggaatctgcaactgggcgaattccgagaactcacgtccggtaaaaagctcttggatctccgccgccgaatagccatcggcaaacaaggtgcccattaaagctcccgcactggtaccgactataatatccggtcttagcgcacattcttccatcattcgaaatacgccgatatgcgcaaaacctttcgctccgcctccgctaagcgccaagcccaacctatagggtttatggtttgtctcttctgccatttatttcttgtctcttaatctggtaacaaatatgctgttttttttaattagaaacattattattagggaaaaagtttccatcctcttttatttttgctacatttacacggaaagcaaaggtgttgtcacattgttttcttaagtataacattaaatctaccatgttatgattacgagtattttctggattattccgttagcgtctgtcctagcgctagcatttgcctggttcttcttcaggcaaatgatgaaagagagtgaaggaactgagttgatgaaaaagatcgcctcctttgtgcgtgaaggggcgatgtcgtatctgaaacagcaatacaaagtagtcgcctcggttttcgttgtcctagtaatcttattctctattatggcctatggcttccatgtgcaaaacgaatgggtcccgatcgccttcctgacaggaggtttcttttccggattagcgggtttcttaggcatgaagacagcgacttatgcctcggcccgtacggcgaacgcagcccgcacttccttgaacaaaggcttacaagtcgcttttcgaagcggggcggtcatgggcttagtcgttgtaggacttggattgctggatatctcattctggtatatcctgttaaatgctttcatcccagacgaggctttggacccgacccataaactcaccattatcacgacaaccatgcttacattcggaatgggtgcctccacgcaagccttgttcgcacgtgtgggaggaggaatctatacgaaagccgccgatgtcggagcggatttagtaggtaaagttgaggctgggatcccggaggatgatcctcgtaacccggcgacaatcgccgataacgtaggcgacaatgtaggtgacgtcgccggtatgggagccgacctatatgaatcttattgcggttccatcctagcgaccgccgcattgggagccgccgcgttcgtttcttccggaagcgtagaattacaatataaggcggttgtcgccccaatgcttatcgccgctgtcggtatcattttatctattattggtattttcgccgtccgtacgaatgagaacgcgacgatcaaacaactattgaaagccttagccataggaacgaacttgagttccgtattgatcgctatctccacgttcgggattctttatgtattaggcatggagaattggttctggatcggttgttccgtgatcgtaggtctgctagtcggaatcgtgatcgggcaagcgacggagtattatacctcccaatcctataagccgacccggctggtttccgaatcggggctgacaggcccggcaacggttattatctccggtctcggactagggatgctctctacggccatcccggtacttgccgtcgtggtcggtattatttgttccttcttgttcgcctccggattcgacttcacgaacgtgggcatgggattatacggaatcggtatagcggccgtaggtatgctatcgaccttaggtattacgttggctacagacgcttacggccccatagcggataatgccggaggcaacgccgagatgtgtaacctagggaaagaagtccgcaagcgtacagacgcattggattcattaggaaatacgactgccgctacaggtaaaggtttcgctatcggttccgccgcgttaaccggcttggctctgttggcctcttatgtagaagagatcaagatcggtttgctccgtttaggagagaccgtcctgaactttaccgatggcaggagtatcgaaatatctaaagcctcattctcggactttatggtatattatgatgttaccttaatgaatcctaaggttttagccggaatgttcctaggttccatgatggcattcatgttctgtggccttacgatgaacgctgtaggacgtgcggccgggcacatggtggaggaagttcgccgtcagttcaaggaaatcaagggtattctgactggagaggcacaaccggattatgcccgttgcgttgagatctcgacgaaaggagcgcaacacgaaatggtacttccctccgttttagctattatcgcccccatcttaaccggactcatatttggtgtgacgggtgttgtcggattattgatcggtggattaagcacgggcttcgtattagccgtattcatggcgaatgccggaggagcatgggataatgcgaagaaattcatcgaggaaggaaaccacggcggcaagggtagcgaggcgcataaggcaaccgttgtcggcgatacggttggcgatccgttcaaagacacttccggcccgagtttgaatatccttatcaagctgatgagcatggtagcgatcgtgatggcgggattgacggtggcttggagtttgttttaatagttgaccgttagtagttggcaattgacagttagagaagtaaattgacaaattaatagagaaaactaaataattgtcaattgccaactgtcaattgtcaactgttttgtatttttgcgtcgtaaaaacataaaacaattcaacaatgtcaatctcacgctttaatgctgtggagaaggcatccaaccgaaaggccgtggaagccgttactcccgaacacaaagtatctgagtactatggcgagaatgtcttcaaccggaaggcgatgcaaaaatatctctccaaggaaacgtacaaagccttgacccacgccattgacaatggcacacctatcgaccgggaaatcgccaatcatgtggcagccggcatgcgtatgtgggcactggaaaaaggagtcactcattacacccactggtttcaaccgcttaccgatggcaccgccgagaagcacgacgcttttgtagaacacgatggcaacggcggcatgatcgaggagttcagcggcaagttgctcgtccagcaagaaccggacgcttccagtttcccgaacggtggacttcgcaataccttcgaggcccgcggctactccgcttgggacccttcctctcccgcttttatcgtagatgacacactttgtatcccaaccgtatttatcgcttataccggtgaagcgctggattataagaccccgctgatccgctctatcgaagtattgggagaggccgccaaggacgtatatcggtatttcgatgaggatgtcaataagataattacttaccttggttgggaacaggaatatttccttgttgacgaggacttgtattccgctcgtccggatctctcactgaccgagcgtaccttgctaggacatgagagcgcaaagaaccaacaattagacgaccattattttggcgctatcccctctcgtgtacaagaattcatgaaagacttggaaaccgaatgctataaactaggtatcccggtaaagacccgccataacgaagtagcccccaaccagttcgagctagctcctatttacgaggaatgtaacctagccaacgaccataaccaattattgatgtcggtcatgaaacgtgtctcccgccgtcataatttccgtgtattattgcacgagaagccatttaacggggtaaacggttccggtaaacactgtaactggtctatgggaacagacaagggtgtaaacttattctctccgggtaaagaccgtgaggacaacctacgcttcatcactttcgtggtaaacaccatcatggccgtttataaatacaacgctttattaaaagcgagtatcgcttccgccacgaacgcacaccgcctaggcgcgaacgaggcacctcccgctatcatctccactttcctcggaacgcaaatcagtgatatcttggataagttcgagaatagctctatcgaggacgctatcgaggtagacgataaaaagggcttgcatcttggcttcgggcagatccccgaactgctgttggacaatacggatcgtaaccgtacctctcctttcgccttcaccggaaaccgttttgagttccgtgccccgggctcttccgtgaactgcggatcggccatgttagcgttgaactccgccgtagcctatcaattgcaacaattcaagaaggacgtagaggctttgcaagcggaaggaaaaagcaaggaagtagcgatcttcaaggtgctgaaagcctatatcaaggaatctaagccgatccgcttcgatggaaacggttattcggacgaatggaaagaggaagctgccaagcgaggtctggattgccaaaacagtgttcccttgcaatatgacgcttatcttaaaccggagtcgatcgagatgttcacgtctaccggcgtacttacccagaaagaattggaagcgcgtaatgaggtaaaatgggaagtctatatcaaaaaggtacagatcgaggctcgggtattaggggatttatccttgaaccatatcatcccggtagccgttcgctaccagagcgtattgctggataatatagcgaagttgaaagagacattcggcgatgacccggaattccgcgatatgtcggaagaaccccgtcgcttggttcgtaagatagccggacatatctgtgccgtgaccaagaaagtggatgagatggtagaggcccgcaagaaagcgaaccgcttgaccgatatgcgggaaaaggcgatcgcttaccacgactcggtagccccttatttggatgagatccgtgaccatatcgatgatctggaactgatggtggacaaccagatgtggccgttgccgaagtatagggaactcctgtttatccgataaaaaacaccagtactggcgttgccttgcgccagtatcggcatagcctcacactgatataggcgcagccttataccgatactggcataaggctacgcctatactcccgtttaccacttcacataagaagcattcatcaagaagtcataatcatgtttcatcgcttgcagcggtgtcatattataacgctcttgctcaatgaagtaatcctctaatccggctttctccgccacagcgaataaggatttgaagtctacgattccggcgcccatctccgtgctgccctttccatctgcgttcgcgtctttcaagtgccagttggcgaaacgaccgggataacggttcacgtaatcatgacatttaaaaccgccatacactaattgagccgtatcgatctggaaagtaaccagccctttgtccgtattctcgatcatcacgtcgaacgggatcttcccttccagctcatggaattcatccacatggttatggaaagcgaaacgcaacccattcgccttcgcgatctcaccacatttattaaattgatccgctaaacgcttcacgtccgaaaggctcttgatatctttggagggataacccgcctgaacaatccatttacagcctacctctgccgtatcggcggcattctttttccagaagtcccatcccttggtatcaccctccgccagcaaaccgcttccggtatgggaacctaccatacgggcacccagatccgccagatatttcttcatctcggccggggatttcccgtagaatttgccatcccggtaaccggcggcttccatccgtttataaccgatatccaccaaagccttcatcgtaccgtcaaaatccgtcttcaagtcgtcccggacactatacaactgtacacctatcgctttctctttcttagccaagatagaggcaaagccgttcggtactacactcagcgcagccacagcggcacccgctttcaaaaaattccgtctcgttatcatcatactattctttaagattaacgtcgctaaaggtagcaaaattatttctactttcgcgcacatttaaacaaacgatcatgcaaggaacaaaaaatctgaccgaaggggtcatctcccggcaactattcaatctggcgatgccgatcatgggtacctcatttatccaaatggcctatagcatcaccgacatggcttgggtaggccggttgggaagcgaagccgtagccgctatcggcgccgttggtatccttacttggatgacgaactcgatctcttacttgaataaagtaggctcggaggtgagtgtcgggcaaagtatcggggcgcaaaacgtggaagatgcccgaggattcgcttcccataacctaacgatcgccttgatcctctcgctttgttggggattcttgctattcgtcctcgctcatccgattatcggcttctacaaactggaggaaccgatcgcgttgaacgccgtggaatatttaagaatcgtcgcttccgcattcccatttatcttcctctcggcggcgtttaccgggattcataatgcggcgggattgagtaagattccattttatatcagcggaacaggtcttttactgaatatggtgctagatcctttatttatactcggcttccatttgggcacggcgggcgcggcttgggctacgtggatctcccaagcggtggtttgcggactattcgtctatcagctgaaatgccgcaataaattgttcgggggattccctttctttgtccgtttaaaggaacgctacaccaagcggatcttccaattgggcctgccggtagcgttattaaatacattcttcgcgatcatcaatctttttatggctcgtacagcttccacctacggagggcatatcggtttgatgacgcttacggcaggcggacaaatggaggcgatcgcatggaacacctcacaaggcttcagtacggccctctccgctttcaccgcacagaactacgccgcacgcaagaaagaacgtatcttgaccgcttatcatacgacgcttaaaatgacttctatcatcggtgtactctgcacgttgttattcgtcttttacggtagcgaggtcttctcgctgatcgtgccggagcaagccgcttatgaggccggtggtatatttctccggatcgacggatattcgatgatcttcatgatgctggagattaccacgcaaggcatgttctacggtaccggccgaacggttccaccggcgatcatcagcatctcgtgtaacaccttacgcatacctttagccatcgggctagcggcagcgggactgggtattacgggtgtttggtgggcgatcagcctttccagcatgctaaaaggtatcgtcgctttcatttggttcagtatcttacagaagaagatcttgtaagcggaacaattcttaccgattttccgtacattcgcgattcaaatgacaattaattaaaaaacaaccgatatggataacaaattcaaaccggaaaccctgtgcgtacaggccggttggcaacccaagaaaggagaaccccgtgtcctcccgatctatcaaagcacgacattcaagtatgagacgagcgagcagatggctaaattgttcgatttggaggaaagcggctatttctatacccgccttcaaaacccgacaaacgaggctgtagccgccaagatcgcggcgttggaaggtggcgtggccgccatgctgacctcatccgggcaggccgctagctttttcgctttcttcaatatttgcgaggctggcgatcatatcgtaagcgctaccagcatttatggaggtacttataatctactggccgttaccttgaagaagctgggcatcgattgtacgtttatcgatcaagacgcgagcgaggaagagatctccaaggctttccgcccgaacacgaaagcgatgttcggcgagatgatctccaatccgggcgttatggtattggatgtggagaagtttgcccgcatcgcccataatcatggcgtacccttgatcgtcgataatacgttcgccacgccgatcaattgccgtccgttcgaatggggagcggatatcgttacgcactccacgactaaatatatggatggccatgccacgagcgtgggtggttgtatcgtggacagcggcaatttcgattgggaagcgcatgccgagaagttcccgggactttgccaaccggacccttcttaccacggattgacctataccaaggcattcgggaaattagcgttcatcacgaaagcgactagccaactgatgcgtgacctcggagcgatccaatccccgcaaaacgcattcctattgaatctgggattggagaccttgcatcttcgtgtaccgcagcattgcaaaaacgccttggcggtagcgcagtggctacagaaatgtgataaggtagcttgggtgcattatccggaattagaaggcaacccgtaccatgagctcgccaagaagtatctaccgaatggctcttgcggtgtattatccttcggattgaaaggtggacgtgaggtggcgatcaagtttatggatagcttgaaactcgccgctatcgtaactcacgtagcggatgcccgtacttgcgtgcttcacccggccagtcatacgcaccgccaattgagcgacgagcaattgatagaggctggcgtggctccggacttgatccgcttctctgtaggtatcgagaacgccgatgatatcatcgccgatattgagcaagcgctcaataaataagacatctgtgccatgctgatgaaacgcttgtgccatcagtgtggcacgcctgtgccatcagcatggcacacctgcatctacagcacggtactgctataagttcctagataggcaggaatctccccagacgcgccacccaatttgtcgtaatcctccctaggctcgttaccggatgttcctcacgcaacaaatcctcacggaactcacgaagaataagccaatccgcctgtttcacccaatgccggaagaccggattctccacatgactttccgaaatggataataacacgtccagatcaaaacaatcagcgacaacgcctgcgccagacaaagaggcatcgtaagcattgcaagcttgctcaatatgtgtaggaaccatcaatacaggtttattcagatacatcgcctcacatacggattcgaacccggcggtcgtagcataagccttcgcccccgacatataacgtagaaacaacgtatcatccagctgatggaaagaaaggcaatcgtctattttcacctcggctcgctgatctttcttatcccaaaagaaatgcatcggaaccgaaggatgacgggaatgccaagaacggatctcctcactaaacccgctattcaacaaataaccatgcaaataactgccgttcgagggaaccgcatccaagacttcttgccttaataaaggaggaaccacgactattcctcccaacggcgcctcgcgcatcttccggaaagacaaggctaattttttgacggagcctatcgccgttaatctcgtaaaaaatcgtagcgatgccaacgacaatgtgctctgcttcgggaaaacgaagtccggatgcaagaatagatattgatgggcgatacataccatcgttgctttcggacggagaatcaagtaagtcagccccgtcaatagctcgtagaagttcacgacaacatccgcatccgtctgccgaatcatccggtcgatataacggatacttcccatgtatttatgcagacgcaatacattatataatacgctacgcatcaaactcacttgtttattcttagccgtcggtaaaaaattcggactctcaaacagatataccggcgattgtatcttattcaagaagaaatccggcaaacggcgggccgggctttttcctaccaacacaccaacgatctcatgtccttcggccatcaatttctggcgtaaggataacgcttgggtcaagtgcccacgtccctcaccttgtatgataaacagaattttcatacggcatccgcatatagttgtacattattatatgtaacaatatcccactctccttgttcatcctccacgagagcggtcatgctttccacccaatcgccggaatttagataatgcacattaccataccatacgctcgccgcttgatgaatatggccacaaataatcccatccaaatgcttggcctccgctaaacgtaccagctctttctcaaactccgagatataagagaccgcacttttcacccggtgtttcacctcttgggataaagagaaataaggttttccttgccgctctctacgatgattgtaaaccttattcaaccacaataaaaaagtatatcccacatccccgagcatggcaagccaacgcatatgggtcgtaaccgtatcgaaaatatcgccatgtgtcacgaaatagcgttttccttgtctcgtcttcagtaaataatcctttacgatcgatatattggagaacttaaaaggagccaagctatcgagaaaatcatcatggttccccactacatagataatctccgtaccccttttctccatcatcttcatcaataccttaaagaaatcggtatgcttttgtttccagcgtttaccggatttcttcaattgccagccatcgatgatatcaccattcaaaatcaatcgatcgcaatctacgtgcttgagaaaacgggtgacctcctccgtccgggaatgttccgatcccaaatggatgtctgagaggacaatagtcggatagtactttcttaatatcatcttttccttgtttaagatgatacaaaagaacactttcggtattacaagctcacgacagcctaatgaaaaagacataacaaaaaggccagctcttcacaaagccggccttttctcgtttaactttaaatattaaaaaattatgatgacattttactttacctattcttctgattgagtagcctcgtaagcctttaacaacttctcttgtacatcggcaggaactaactcgtaactagcgaacttcatcgtaaaggaagcacgcccgcccgtaatggagcttagtgaagtagaatagttagacatctctttcaaaggaactttcgccaatagtttctcaaatcccttctcgctattcatacccataatcaaggcgcggcgtccttgcaagtcactcatcacatctcccagataatcggcaggaacggaaacctcgacatcgtaaacaggctccaagatcttagggccagcctccttgaaagcggtactgaacgcattgcgtccggcaagcatgaaagagatttcattactgtctaccgggtgcatcttaccatcgtatacgcaaatacgcacgtcgcgagcatacgaacccgtcaacggcccttgctccatacgagccatgataccttttaggatagccggcaagaaacgagcgtcgatagcaccaccaacgatacagtttacgaacacgactttaccaccccaatccaaatcgattatctgagtatcacgaacattcatcttatactcctgtccgccgaaacggtaggtatccggagcaggcataccttcataataaggctcgataatcaagtgaacttcaccgaactggcctgcgccaccagattgtttcttatggcggtaatccgcacgggccgctttcgtaatcgtctcacgatacgggatcttcggctccagatattcgatcggcaatttatcattattctcgattctccatttcaatgtacgaagatggaactcaccttgaccggaaacgattgtctgcttcaattccttggactgctcgattacccatgtcgggtcttcctcacgcatacgtatcaagatttccatcatcttctcggcgtcagcctcattcaccggcttgatagcacgacgatatttcggatccggatatttaatgaagtcgaaacgataatcacaaccctttccgttcaatgtattaccacggcgaacatcctttaacttaacggtcgctccaatatcacccgccaccatttccgtaaccggggtacgagtttgtccggctaccgcaaataactgtgcgatacgctccttggaaccacgatcggcattcatcaaatcgtcaccttcttttacttttcctgatatcactttaaaataggaaacctgaccaatatgaggttccacggtagtcttgaagaagaacaagctagtaggaccattcgagtccggagtcacctctacgccttccgtagtaatcagacgaggcatcttgtcggtacaaggaaccacgttacccaagaactccaacgtacgacgaacacacatatcacgaccggcacatacgcagaataccgggaacataccgcgagtaaccaagcccgcacggataccggcacgcatatcatcctcgctcaaggcaccttcctcaaagaatttctccatcaaagtatcatcgttctcagcggcggcttccaccaaggcttgatgcaactccatcgccttatccatttcctcggcggggatttccaatacatcaggaactccaccttccggtttccaacgatacatcttcatttttaatacatccaccacggcattgaaagaagagccgcagctaatcggatattggatcggaacgatcttactgccccaacggtctttcaactgggcgatagttccctcatagtcggctttatcattatcaagctgattgacaacgaaaatcaccggtttatgaaattgttcagtataccggaactggttaatggttccaacctcaacaccgtactgggcattcaataccatcagtgccgtatccgtgacattcagagcggaaacagctcctcccacgaaatcatccgaacccggacaatcgatgaaattcagcttccgatcctgccactcaacactgaaaacggttgagaaaactgagtatccatactctttctcaaccgggaaataatcggacaccgtatttcctgcctcaacggagccgcggcgttttataactccaccctcgtaaagcatagcttcagcgagagtggttttcccagagcccgaacttcccaagatagagatgttcttaatttcatttgtttggtatactttcatgatatcaggatttatttgagtttaacaatacgtttatttggcgtgaatcactttcacgagggcgcaaattagagattgtaaaggaaaaaagcaattatcgcccggtgtttgagaactatgttgtgcagcagcaaggttttttgaaatttaaattatatctttgtgtaaagatataattgtgtccatacagatggcaggcttatacatccacgttcctttttgcgccaagcggtgtttatactgtgactttttttccaatacggagatgaagtataaagagccgtatataaacgcacttataaaagagatggaattgcggaagggatatataggaaacgaagcattagaaaccatttacttcgggggaggcaccccctctcaattagacgagaaggattttggcaagatattcgaggccatctatcgtcattttgatgtagccaagcaaatggagattaccttagaggcgaatccggatgacatgaaacgagaatatgtatcgcttctccgtaattatccttttaaccgggtcagtatgggtgtacagagttttcatccggaagatttgcgttttctgaatcgtcgccatgaccgggaacaagcgattaaagcagtagaactatgcaaggaatatgggattacaaatatcagtatcgatttgatctacggactccccaaccaaacgcagcaagcatgggaagagaatttgcgacaagcgatccggttggatgttccccatctttccgcctaccacctcatttacgaggaaggtaccgcactttacaaattgctggaagcgggaaaagtgacccccataaacgaggagttaagcgtctcgttcttttccacattaatagatcggttggcagaagcaggctatttgcattacgagatatctaatttcgcccgtcccgggttcttctccaagcacaatagctcctactggaccggaaagaaatatctaggcctcggtccttccgcccattcttataacgggatagaccgggaatggaatccatcttctctacctatatatatagacggtatagaaaatgggcatccgacaatagaatccgaggatttagacctatgcacccggtacaacgacttcatcatcaccggccttcgaaccatgtggggagtctctttcgctgatatccagacaaaatttggcaggaagctcctttcttattgtcaaaagcaagctcaaccccatatcaaccaaggtctcttattacaaaccggtgacaaattgattttatccaagtcaggaatcttcgtttccgacggaatcatgagtgatctactttgggtataaaaattaacaaaaccaccgctttccccaacaaacctgttagttaaaagtacatttcctgcacattttcacgatttttgagaaataaaacgacgcatattaaaaaactattacatatatttgcagcatcaaaaacagcaaacagtgccatatttgtatataatatcaggttgcaacggagcaggaaaaacaacagcttccttcactattttaccagaaatgctaaaatgtagggagtttgttaactcagacgagatagccaagggactttccccttttaatgcagacagtatagccgtcgccgttgaagctagtcgtattatgtataagcggataaaggaactcatcggtgctggtgagactttcgcaatggaaactacgctggccacccgttcagtcgcaaacctgatacgggaagcacaaagggaaggttattatgttacattgctttacttctggctgaatacgccggatctagccgtggaacgtgtgaaaatgagggtagccgccggaggtcacaatattccggaagcaacgatacggcgtcggtatgaggccggtatccacaatttattcgagctataccttcctattagtgactattggatgataactgataattcgatgtctcccatggaagtgatcgccaagggattcaagaatgataaaagggaagtgtataatctagatatttttacaaaacttgaacatcatgaatgagcaagaagttagagaattcgaagagaatatagtaaaaggtgcaaatatagcttttcagcgtttggtgaatcagaagaagaaggaagacggagagttggtattctctcgtaacggtcatatcttcagagtcaaagctgttgatcttgacaagatttattaagttatagatatacatatacaaaaagaggagacgtatctttcaaggatatgtctcctctttttggctttatagaaaaaggaacttaggttcatgggcgaagtatgttaacatacttcggcatttcagttaacatacttcgcccacgaagttaacttacttctctatcttgagaattccatctcgttcaataaataaccggctccggcatatttatcgattacgaataggacataacggatatctacgataatactgcgttgataatcgggcagatattggatatcccctcctactccttcccagttacggtcgaaattgataccgattaactctccttgtccattcaataccggactaccggagttccctcccgttgtatgggtcgtagcacagaaggcaaccggcattttaccgttaggcatcttataagggccaaagtctcctgcttgatataattccttcaaacgagcagaaaccacaaattcccaattcgtagaatcctccttctccatgacgccgtctaaagtggtttgatgaccataataatcgcaatcacgaggactgtaacctttcacctgcccataagtcagacgaagcgtagagttcgcgtccggaaaactagccaagtctccatacatcgctaaaagtcctttcacatacgcacgatgggcgatcgcatatccggcatcaaaatcagccaaggccttatctaacgcctttttctcatcctttacggattgtgcgaacagaatcatcggatcttctctcaaagttttgacagacggatgctccttgaacgcattgaagttcttctcactaccatagatcgatttatcaaacagataatcaacgaatttatccacatcccccttaaacttgctatcgattacggaaaaataagccggctgcgacttcggagcgaccaaacgcctatattcctttaacatgacttttgctatcttcttatcaaccatcggcgcataatccttatcagcgaaacggtggaaagccctctccaattgagtgacctgtttttgctgctcggaacgatctttcccctccaaagcctcacaaacagtctcgatatcggtcggaactttggagaactcgatgccacggctcaatgcctcatccaacatccaactacggaaacgcaaatccttacgatcattaacgatctgctccaatgtcagaagcgcttccggataagcaggctcacacatcttcttcgaccaagcgatcaaacgatcctgctcatcgtttttcacctgctcaaaattacgtttgttgatcgcccagttactaccgatcgcattcttataagcgttcgtagaacccgcatacttactagcgtattgaatccggacttgcggatctttcagcatttcttccagcatcgcctcttgacggagattacggatattgatacgtaccgcattatctatatcccgacgttcggctacctcccatgaggtatagtatttattggtacgaccggggaaacccatgatcatggcataatcgttctcctccacaccttttaaagaaagctttagccaacgtttcggacgaagcgggacattggtttccgaataaggtgccggatttccgttcgcgtcggcatacacacggaaaagagagaagtctccggtatggcgaggccacatccagttatccgtatccgccccgaacttaccgatagaggaagggggagcaccgactaaacggacatccgaatagaccttcttggtaaacatatagtacttattacctccataaaaagccttgatctcgacttccgtaccggggttatcctgtaagaacttctcacctactttcgctttagcgaggccattcaagtacttagcggacaagaattccatgctgttcggatccgtgatctttttcagttccgtcctcacataatccgtcacgtcgtcgatcttatcgataaaagtaaccgtcaatcccggattcggaagctccttatcacgagacatcgcccaaaagccgtccgtcagataatcatgttccaaggtactatgccgttggatgctactataaccacaatgatgattcgtcagcaccaacccgtccggagagatcatctcgcccgtacaaccaccgccaaaacgaaccacggcgtctttcaaggaaggagcctcggcgctatacacttcctgatcgcttaatcgcagaccaagggcctgcatctccgcaaacttttgttgcttcaataaagggagcagccacatgccctcatcggccaagaccggaaacgccaatatagtggccgctacagataaaaagagtttcttcatgtatttgaactattaaaaggatgttttgtcaacattgaattataataacggcgatctccacttacctccttacccagccaagccggtttctcaaaaggctcgtcctcagacgataactcgatctccgcaaggatcaacccttcattcgctccgtggaaaacatcgacttcccacgtatggctgcctctgggaaccagataacgaaccttgtcgatcgcacccggctcgcaaagctccaacaaccgctcggcatccaccagaggaatcttttgctcaaactcataacggctcaagcctttctcatccgaagcgcctttgatcgttaggaatccctcctctccccggatacgaatacgaaccgtacgtccgggctgtgagcaaatatatccctgcacgatacgggtggagctaacagcctccggtaaaaaatcaccggagaccaagaatttccgttctatctcaatggccatgttgcgaggtatcagccttaatcgttaccatcgtcgcaccaaaaccatattcgcggaaagaagcgtcttgaaaataatgttgcttataacgggtcttcaaatccttctcgatagccttacgcagcacgccatcgccttttccatggataaagacaatcttctgtccgttattaagagcgtactgatccatcacctcacggaattttcccaactggtacgtcagcatatccgcattgctcaatccattcgtattatccaacaattcggttatatgcaaatcgatctcaaggatagcgctattcgtcggcttctttttcacgatttgccggggaaccctacgttcctcacgaaccttttgctgcatagcttccttcaactctgccgcagagaccaatagttctctctcgggcaagtcattgcggataatcggataaatcaaggcatcctcctcaaagaaatcattctccataaagcagtgaagcttgtagaacttaaccgtatccaagcgcaactctacagatacggcgtttttcaacgaatagggtttatctttcttgaaagcgatcagttgcacgcagatcctttccagatcattcaactccggcttaccgaactcctctaggaatattttcgtattcggctcgataatcccgttataacggcttgtccagctattattcgtccggttcatataattgaagaacaaatagtaattgctatcattcacgaaatacgtctcatagccgcattgctgaaacgccttcggatcgaccgggagataagccagatacacattcagacgctctccctccggtgtctcctcgaccttttcctctttgggttcaggcttctttggggaaggagtctctaccggagcctgtactttcggacggttcgagctatgcacttgcatatcattacccccaaccacgacacattccttgatcaaggcaggaacctcaaacccatcctcatcctcaaccaacacttggtcctttccacggaatccacgtacgactccacctcccacactattcaggaagcgaactttatcacctatttgaatactcatattctataccttattatattatgcgcacaaaattagggaataatccgcgaatccgaaacctatttactacttttgcacccggaatccgtacaaacggatgttttttaacaggacagaagaagtaatgaagacgcaagaaatacgtatcgaagattataactattcgttaccggacgaacgaatcgcaaagttcccattgcctaaaagggatgagtccaaacttttactctaccgtaacggggaaataagcgaaagtatctttaagcatatcacggattatcttccccaaaacaccttgatggtattcaataatacccgggtcatacaagcccgcctacttttccagaaagagaccggcgcacgcatcgagattttctgtttggagcccatcgagcctcatgattacgccttgatttttcaagagacccgacgctgtagctggacttgcttggttggcaaccttaagaaatggaaagaaggcactttatccaaaacgatcttcattaaggatcaaccggtcgtgctgacagcagataagaaaaagtctcatggtgacacacatttgatcgaattcacatgggataacgagacttatacattcgccgatatcttggatgccgccggggtcttgccgattcctccttatttacacagagaaacagagaagagcgacctacagacctatcaaacagtttattctaagataaaaggctccgtcgccgcaccgaccgccggacttcatttcactccggaagtacttgccgatatagatgctcggggcatcgggcgggaagaagtcaccttgcatgtcggagcgggcacctttaaaccggtaaaaagcgacacgatcgaagggcacgagatgcacacggaatttatctccgtccgccgcagttccatcgaacgtatcaaaagcaaccttggaaatatcatcgccgtaggaacgacttccgtacgaaccttggaaagtctctattacatgggcgtgatcctagataataaccccgaagcgacttccgaagatctcgtcgtaaaacaatggatgccttacgacatgaataacaaccggctgacagcggagcgttcccttcaaaacatcctcgattatctggataagcatgatgcggatacgctggtaacggctacgcaaatcatcatcgccccgggctatgagttcaagatcgtaaaaggaatcgtcaccaacttccaccagcccaaaagcaccttgctcttgctgatctccgctttcgtaaaaggaaactggaaatccatctatgaatatgccttagagcacgatttcaggttcctgagttatggggatagttccttgttattgtaacagacatacaataagatcccatacaattcgttatatttgcacgaatatattccagattgaatgaaagcgcattttactatatatgttttatttttgcttatcgtatcttccttgtattcctgcaaatcggcgaagttgagcgatgccgaggagaagcagcgtatcggggaatactatgaggcagccgccatttatcgtaaagtttacacgaaaacatccccgaagaaaagggatttgcgcggctatatcgcttaccgtatggccgaatgtaaccggttgatcaacaatacggcgaaagcgactagtgcctatatgaacgccatccgctatgattaccccgatagtaccgtctacctacgcatgggacagatgttacagaagaccggacgttatccggaagcgatcaagaactacgatatctatatggagaacgatcctagcaatttattagccatcaacggcatacaaggatgcgagttagctcccggatggaaaaagaaccctacccgctacgaggtaaggcgcatggacaaattcaattctcgccgaggagaattcagtccgatgctggccggagataaatacgaccaactatacttcgcctcctcccgctcgaaagacaaggacgcgaaagtcagcgccatcaccgggcaaaataacaataacctcttccttgtcaagcaagacgagaaaggggcttggctggctcccgtagagctcgaagacgaggtgaatacggaatacgacgaaggaaccccctctttctcccccgatggaaacacgatgtattatacctattgcgcccaagatccggaaggccctcgtaccgccgagatttacatatctacccgaagcagcgccaaatggggaaaaggaacccgtgcgacaatcgtaaaagactcggttaccgccctcggccatccctccatctcgccggacggcaaatacttgtattttgtatccgacgccgtgggcggtttcggcggcaaggatattttccgtgcccgggtagcgggaaacgatttcggcccgatggagaacctaggagaagagatcaacacgccgggagacgagatgttcccgtatgtccgggattccgtcaccctttatttcgcgtccaacgggcatccgggaatgggcggtctcgatctgttcaaggccacgcaagacagtacggggaagtggaatgtcgagaacctaggagcccccatcaattctatgggagacgatttcggtatcaccttcgccggaaaagaggaacggggcttcttctgctccaaccgcaacgacgcacggggctatgaccatatctattcctttgaactgcctacgatcaccatcttcatcgaaggaatcgtaaacgatgtggatgaatatccgatcgaggacgctaccgtacgcatcgtcggaaaagacggactgaacgtgaaagtcccggtcaagaaagacggaacctatcgtgtcgagttggaacgagacatccgttatgtcatgatggccagcgcccgtggttacctcaaccagaattacgagttgcataccggccccgaggagaaaaacgagacgtatatcgtggatttcttcctctctccgatcagcaagccggttgttatcgataacattttctacgatttcgataaagcgacccttcgtccggaatccaagaaagctttggacgagatgatcaagatgctgaacgataacccgaacgtaacgatcgaactgggtgcccacacggaccggaaaggtacggaccagtataacgagcgtttggctcaacgccgtgcgcaatcggtcgtggattacctaatagcgggaggtatcgaggcggctcgtctggaagcgaaaggatatggagaaagcgttcccaagacgatcaataagaagatggctaaacaattcgatttcttgaaagaaggcgatgtgcttaccgaggaattcatccttgccctgccgccggaacagcaagagatcgccgaccagatcaaccgcagaacggaattcaaggtcttacgtacaaactataacttattttgagggagcaaagagcgtgatctccttaaaagagaccggccaatcgatcgcactcatcagcacatcgaaggacaggcgttgctgataagagaccgaggactcccttgaatacaagtcatgagctaccaaaccgatcatcatcttaaccttataatgcaattccttggatagtaccaagcaggcaagtacactcaaatctctcgcttcttcccaatcccgatccgcaaaacacatctccttttgaagtgccggataatgacgagtccgcatgatcagatccggatcacggacctcacacgcaccttccactacatccaataatatacgacagacagccaaacgttgctttttaattacctccatatacgtttccctcaaaccggaccgttcaccttgttcggtatttctatatgctacaaaaaagaagcgtgggaactgttaatctactattcgaaactgaggcatcgccaaacacccatcggacaaataataaacaacagcccacgccttattacgtatactattaggcagtatatataacaagcgtgagcgtttagttgcctattatctctgtccgacttgaaacttggcgattttcagttccaaagataatatcttaaacgcttatcgtaatcacactttgattcataaacccttgaatttccacaagagtttactttatcgatacaaatataacgctttttctcatacatcatatggatttatttttctcttttaaaatctattgggaaaagatagcgtatactctctagcgataaattcttccactataaacaagatgcttccgtgagtaaaaaagagaggcgcatatacatcctatttatgtatatacgcctcaccattatgtggatatttccaaatccggaactttcttccttatttactctaccgagaacttataaatacactcactcgtatatttctcgcccggacgaagcactacgctcgggaatgccggctggttcgggctatccgggtaatgttgagtctccagacatagggcgccacgatgtgggtaaaccacacctaacttgcctttatcaccagctttcgtcattgagttaccggcatagaattgaagacccggctcgttggtgtaaacttccataacgataccgcttgtcggagatacaactttagcggctaccttattgatatcgccggcggcgttcaagatccagttatgatcgtaaccaccaccgtaaaccaattgcgtaaacggattgtcgatatcagcgcctaccactaccgatttgcggagatccatcggcgtgccttccacgggttcgataccggtcgggatcaaagtctcgtccaccgggttatatgtatccgcgtcgatcatgatcgtatgatccatgatttgcgagccgggaacaccggaaaggttgaaataactatggttcgtcaaattcacgacagtagccttatcggttgtagcctcgtacttaatatcaacggcgttatcatccgtcaacttatagatcaccttgatatccagattaccggggaaacctgcctcaccgtctttcgatagataagtcaactccaaggtttggtcatcgatctgtttcgcgtcccaaactaccgcgtgatatcctttcggacctccatgcaagcaatgcccgttattattctgtggaagttgatactccgttccgtccaacgtaaacttaccattcgcgatacggttgccataacgtccgatcaaaccaccatagttattatccggaaaagctacatactgagcgatattatcatacccaagcacaacatccgtcatcttaccgttcttatcaggcaccatcacggaaaccaagcgtccgccccaattcgttacgcaagcctcagcccctttcttattcttcaacacatacaaagcagtcggcttaccatctacctcagatacaaaatccgacttcatcaaaccagaaagagtggcctcttccgtagccgcccccttctcattcttacctccgcatgacaataacatacacattgccatgaccgcaaaacaaagttttttcatctctttcctttaaaattaataaatgttattcttcgggcaaagatacgcattctatccacatgaggtccaatatccttacgcattttctcgggaatccttaccgatttctactcgaagtactacacccttcctcctgacatctttatcatctaccaattggtagatgatcatgcaacagccgttggaagatcatgcaacagctgttagatgatcatccaacagctgataaataagctagaccttcatacaaatctcctaatacctcccgaagaaaccgccaaggaaacccgaagaaaccgtttgaatcctcaaccgatttcatattttgacccgttattctagtataatacgattcacttttgtacatttgcacactattgtaataagtgagtaatgaaacaatatttagagctgctcaatagagtgcttaccgagggagttagaaaagaagaccggacgggtacgggaacgatcagcgtattcggtcatcagatgcggttcaatctggaagagggattcccgctactcactaccaagaagctgcatctgaagtctatcatctacgaattgttatggttcctgaatggagataccaacgtaaaatatctgcaagatcatggcgtacgcatctggaacgagtgggccgacgcggatggtagccttgggcatatatacggttaccaatggcggtcatggccggattataaaggaggatctatcgaccagatcaccgaggccgtggagacgatcaagcataacccggattcacgacgaatcattgtaagcgcatggaacgtggcggacttagacaacatgaacctgcctccttgccacgctttcttccagttttacgtggcgaacggacggttgagcctacaattgtatcaacgtagcgcggatattttccttggcgttccgttcaacattgcctcctatgccttgttattacaaatgatggcacaagctaccggccttaaagcgggagattttgttcatacgttgggagacgcccatatctacagcaaccatttggagcaagttaagttacaattgacacgtgagccacgtgcgttgccacgtatggagatcaatccagacgtaaagagcatcttcgattttaagttcgaggatttcaatttgaccggatacgacccgcatccccacatcaagggagaagtggccgtctgagaattggcagttgacgatggacagttgacagttaattcataaatcataaattacaaatcataaatcaataagtctatgagtacaatttctatcatcgcagcaatcgcagataaaagcgcgatcggaaagaatcagcaattattatgtcacatgccttcagacatgaagcgtttcaaggaattaaccacgggacatgcggtaatcatgggacgtaagacattcgagtctctccctgtagcgccactgcccaatcggaagaatgtcgtattgacgactatgcccgaagctggtttcgtgaattgtttcgcttgcgagtctatgggggccgctctggatttatgtgagaaagaggacgagatattcatcattggcggcgcattggtctacagacaggctttgagaatagccgacaaaatgtatattacccgcatccatcatgagtttcccgacgctacctcgttctttcccgtcgtaaactgggacctttgggaagagactgaacgtgaggagtatcccgcagacgagaagaacccttacccctacacctacatcacctacgtgcgcaaaaaataaacattaacgtacgttttacaactttttgctctttctttgtatctatataggaaaggtttattgttaaacttataaaacccaaaagatatgaagataagagcaattattttatctgccctgatactttgcggcatctcggcggttattatgtatagccgggccgcccagcctcaacaaaaaagttctgttatcacgcaagctataaacgataagaatacccctatggtgatcaagaatcttatccttaaaatgaaagaacagatggaggtaaacgatgatcagttcccggaactgatcaaggaggtggagaattacaccaacagttgcgccgactcggcttccgtggcggtattacattccatgctggcggagatgtatcagaattactaccaacggaaccagtggaccatcaaccaaagaacccaattaagcggttatatcccggaggatatccgggtatggacttccaacttattcacggataagatcaaggaagagatcgatttatcattgcgacctacggctttattgcaaaatacgcctgtcagcaagttcaaggatattctggagatcggaaaggactcgcaaaccctgcgtccgaccctctatgagttccttgccttccgggcactggacatccaaccaaccgtacagatctataaagacttgatcgcctttcaaaataaggagccgaatatgaaatcggtcctccttacggaattggattacctacgattcctttacggggataaaagggataaagagtctttcgtggcttacatgaacgcattggatgagctttacaggaacttagcttctcaaaactatgccgccgagatcttaatcgccaaattggatttggttagcggcggtatgtttcgttacgtctctacccaatgggattctatcaaagcggaagaggtgaaactatgcgaggagggtatcaagcggtattccggttaccctcgcacggctatcttaaagaatcgcttggcgcaattggaacaacctactttatccgcatctacaaacaatacggtttatccgggacagcaactggggatcaagctggaatataagaatgtacagaaagtcatcgtacaaatctatcgaagctcgaaaacacctttacaagcggcagcccatacatccgcaaaaaaatcaagtagcagcaccttgggacaactcgtaaatgagaagacattctctttgctactgcccaacagctattcgcagcaagatacgaccttacatatatctatggatcaaccgggattgtatgaatgtgtcgtaaccgtacccggacaacagctaaagacgatcaatacggttagcgtaacccgattggccgcgatctatcgtaatctttccggtaataaacaagaggtcatggttaccgactatcttagcgggaagcctgttgatggggctatcgttacttattacggaggtcagcgtcgtagcttgcaagaactgggtaccgtcaagacagaccgggaaggcttggccacgcttccggcgaacagtcaagtattggcgttccaagccagcagaccaggagataccaacgctatgttgacaaatatctatccgatgggttccggccacaaaccggaaaagaacccggtagaagtctcaatctttacggaccgtgggctttaccgtccgggacaaaccattttcttcaaaggcctcgcctatgtaaaagacgcgaacgacccgcatgccgtggccggacagccttttacggtgactttatacgacgctaacgggaaagagatagcccagaagaaagtcacgaccaatgagttcggttcctttaacggagagttctccctccccaaacagaccctaagcggtgtcttccggttaagtaccggacagatgagcgtatatattcatgtagaggaatacaaacgtccgactttccaagcgtacttcctcccgatcaagggcgatatcgctttcggcgattccgtaaccatacaaggcaaggcggctacattctccggcgtgtcgctgcccagcggagatgtcacttggcgtattacacgcaggcccttcctgttgtggaggtatttccgtccgagcgctccgacacaagttgcggaagggagtaccaccctttccggcgatgggacatttagcgtatctttccgtccccaaaaagaggaggatacgaatccatacgcttccgcataccagacctacgaggtatcggctaccgtaaccgatagcaagggagagacccaagaggcgaattacaccttctcggtaggagaatccagtatcgtcttattcacgaacctaccgccacaaatcgagaaagactcggtaaaagccgtagtcgaagcccggacaatcaatggggagatggtttccacctccggtactttcaagatcgtagaactgatcgcgaaccgatccgataagaatagcggagagagctatcaagaaggcaagcaagtagcttccggtagctttaccagtggcaaggagatcagtccggctattttcaacccattgccctccggacgttatcgcattttagtagaagccaaagatagccaaggacgacccagtaaaaaccagtccgatttcatcctatacggaaagaacgacaagcgtcctcccgtattaacccatacttggctgctgaaagagaagacaacttgtttacccggggaggaagcggagatcgtattcggcacctccgacaaggacgcctacgtactctatgaatggtttgccggaaataaccgcatccatcacgagttgataaagctaagcgacgcgaaccatcggtttaagatcccgttcaagccggaatatggagagggaatcatcgtatcctttacgttcgtaaaagagggtgaactttatattacccaagtacccgtagagcttcagctacccaaccggcagttgaccatcaagccgataactttccgggatcgtttacttccgggaagtaaagagagctggaaattccgtatcaccgacgcggactccacgatcgtatccgccgaggtactggccagcatgtacgatgcctcactagataaaatcataccgttcaattggtatttctccccgcagcgaacgatcctgctacaagctccccgtttctcaaccggagccggattccagcgtagttatcaatatgaccagacagaggccaagtatataaaagtacctcaatatcagtatgaccgtttaaattggttcggtctattcaatgagattgtcatacgaggatacggctccagcaaccgggctttcgccacgggaggtatcatgttgaaatccgcggcagccccagtagtggcggaatccatgaacatcatggaagacagcgccgtgttagaagagcctagtgtggaatctacggaaggggaacccgtgttcagcctatccgatcctttcgccaaagagagcagccagccggtaagtccggagcaaatccggcagaacttcgcggaaaccgccttcttctacccgaccttacaaacgaacgaggaaggagacatattcgtaaatttcaccctgccggaaagtaatacgacttggaaactacagctattggccaacacccaagacctgaaatacggtctgttaacgaaagaggtcatcagcagcaagcctttgatggttttaccgaatctgcctcgtttcgtccgccaaggggatgaggtcagcatcagcacgcaagtcatcaacaattccaaggaagcggtatccggccgtgtacgcatcgaactattcgatcccgctacagaccaaccgattatctgcttgagcaagtcacaacgtccgtttgagttgcaaccggatagcatcgctactgtaagctggataatcccggtccccaaacagatcagcctactgggcgtacgtatcctagccgactctgaaaagggaagcgacggggagcagcagatcgtaccggttctttccaatcaattgcttatcacggaaagtaccccgttctatttgctcaaggaaggagagatacaaatccgtatctccgggaactcggagggagcgacaccgttccgtctcacgctggagatgaccgggaatccgatttggtacgcggtacaggcattaccgacgatcacacagccgaacaatgataatatcttatcttggtttgccgcttattacagcaatacgttggcttcctatatcgcccaagcccatccccgcatccggaaagtgatcaaccaatggaccgcccaaggagggaatgcctctactctctattcaaacttggaaaagaaccaagagctgaagaacatactcttggaggagacaccttgggtactggccgccgataacgagacagagcaaaaacaacgcttgtctttattgttcgacctaaaccgtgcggacggattacgggaagcggccttgcaacaactgatccaacaacagaacgaagagggtggatggagctggttcaaaggtttccccgcgagccgtgcgatcacgctttctatcctgaaaggtatgtcacagcttgtacagctaaacgcgatccaatatgggcaagcggagaaagagatgcaaatgaaggccctcaagttcttggacaaaagtatgcaaacggattatgagaacttgctgaaatacgataagaaatggcaaaacgcatggccctcgccggagcaggtagagtttttattcgtccgcagctcctaccgggatatcccggaactgggagacgcccgggaagcgatccgtttctatacgaaccaagcggagaagcactggaatcaatattccttaatcagtaagggcgaaatcgccttgttaatgcatcgaaacggtaaaaaggaggtatcgacagcgatcctgacatggctaaagaagaccgctacgatctccgaggagaaaggtatgtattgggcaaacaaccgcagggggagtgattattttacctcaccgatcgacacgcattgcttattaatgtccgtctttaacgagatcgcgccggatacccagaatacaaaccggatgaaacaatggttgctaaaccagaaacgtacacaaaactgggaatccgtacccgccacggtaaacgccatttacgccttgctactcacaggtagcgattggctgaacacgcaaaacacctgtgtagcgacatgggacggcaagacctacagtaccgcggaaggggaaatcgccatcggttacctcaaaacgatacttccgaacgagccggcaaatagttccgccaatcccgtgctctcgatccgcaaggaaggaaacacgccggcatggggagctgtttacgagcaatacttccaagagatcgacaaggtaaaaggacaaaaaggggtgttgagtgtcgagaagaaattattcgtcgagaccaataacggtaccaaccgccaaatccgtcccataacaccggagcaaccgctccgcatcggagacaaggtaatcgttcggctaacgatccggacagaccgtgaaatgaattacgtattcttgaaagatctacgtgcgggctgcttcgaaccggccgatcaactttccggcccggaatcaagagacggtatctggtattacagatccccgaaagacgtatccgagaatttcttcatcaatcgtctgccggaaggtacgtttgtcttggaatatccggtctacgtatcccgtagcggcgaatacgccggaggtatcagtactattcaatgtatgtacgccccggaattcgtgtcgcacaccgccggagaaagcttgcggatcatgccctaaacaagccttttcttacaatgcccgttctaacctccttacaatgcccagtataaggaggttagaatgggcaccgtaagaaggtaagaatgggcatcgcaagaagcgttatcttcctctaattttcaattttcaattctcaactttcaattgaaatgactatctttgtaattcgaattaaaactaaacgataagatgaaacaaatagtttttattttcatggcgatcctgttagcgacaggaatggcttcagctcagaagaaagcagttatttccgcggaaacaaccagtttcgattttggtaccatcaaggaagcagacggaaaagtatcccatacgtttgaagtatccaatacgggcgatatgcctctggtcattacacgtgtaatcgcgtcttgcggatgtacgaccccggaatggccgaaagaaccggtagctccgggtaagaaagcccagatcaaggttactttcgatccggcaggacgtccgggtcctttcacgaagaccatttccgtatacagtaacgggaaaaccggaagcttcatcatgaacatccggggagaggttgaataagaaatacgtaaaaaaaccccaattggaatgctgaatataaaaaggttgatccttgctcttacagcaattatatctataacgacagcttgggcacaacaaggcgcccaaatcttgtcggacgagttgacttataatttcgggacaatagccgaggccgatggattcgccagtcatactttcacgataaagaatacgggagacgcccctttggtcatcacccgtgttaccgcatcatgcggttgtacacggccggaatggaccaagtcgccgatcgctcccggtaagaccggtgaagttaagataacgtataatccgaaaggacgccccggcccgttttataaaaccgtatcgatattcagcaatggaaagaaagggagttacagcctagccattaaaggaaatgtcaccccgaaaccttcgcagccggtctttacgtatccttattctatcggtgatctgaagctgcatacgaagactgttctattcagcagtatccgtccggaggaaacgttgggcgagaagatcaacattaagaacgagggaaagacctcggctacgattcatctgggtaaagtacctcactatctcaacgtacaggtgaacccggctacccttcaaccggacgaggtcggtgccattacgatccttatggacgccaaggtcctgaagcggaaaggacgagtctctacgcttttgccgatcatggtacagagcgccggaaagaaggaagtatccggagagatccagatctccgccaacgtgatcgataatttcagcaaactatccgctgcggataaagcccaagccccaatagcggaattatccggcactttactggaattcggcaagctaccgaacaagaaaaacatcgttccgttgatcggtggtaaggtatcgggtacatttgagattacgaatgccggaaagactccgctcacgatctacagcgtcacttgtgatgatgagcgtgtcgatttgtccggcggcaagaaagaacttaaaccgggagcgaccgctactttcaaagtaaccttgcgaccgaaagagataaagacaaaacttgaagcacttattaatgtcgtatgcaacgacccgaacgggcctattcgcttgatcaaggtgacggcatacaaataatagattgatatggaacatccagaaaacgatgatcagtacaagggattgaaagtgaataagggcattgcggatgtccctaccgtaaatccttatataaaaaagcgtgtccaacgcaaggtatatacgccttccgaattcgtggaaggtatcttaaaagggaatatcacgatactcagtcaagcggttaccttggtggaaagctctaagcatgagcaccaacaggtggcgcaggagattatcgagaaatgtttgcctttcgccggaaaatcggtccgtatcggtattacgggtgttcccggagcgggaaagagtacctctatcgactctttcggcatgcacttgatcaaccaagggcgtaagcttgccgtactagcgatcgacccgagtagcgaacgctcgaaaggtagtatcctaggagataagactcgtatggaggccttgtcgagagagaaaaacgcctttatccgtccttcaccatccgcaggctccttagggggggtcgcccgtaagacccgtgagacgatcgtattatgcgaggccgccggtttcgacaccgtattcgtagagaccgtgggtgtcggacaaagcgagacggccgtacattctatggtggacttcttcctgttgattcaattggccggtaccggagatgagttgcagggtatcaagcgaggtatcatggaaatggcggacggtattattatcaataaagcggatggagacaatatcgataaggcgaatctcgccgccgctcagttccggaacgccttgcatcttttcccaccttcggaatcaggttggttcccgaaagtattgacttattccggttattacaacataggtatcaaggaaatatgggatatggtcggagagtatatggagttcaccaaaaagaatggctacttcaactataaacgtaacgagcaagctaaatactggatgtacgaaagcatcaacgacacgctgcgggataagttctaccataacccggcggtagaaggcatgctggaacagacggagaaacaagtcttgaacaacgagatcagctctttcgtggcagccaaacggatgatcgatctgttcttggataatatcgctacgaaataggtataaaagcacaagagtgtcgcacgatctgatcatgcgacactcttttttacttgaaccttacatcgactcctttgtcttctttcgctttcacggccaacgcacgcccttgtctctttacctctcctgtgatgaattcaggtatattgtaggatttcataaaacgaaaataaaaatccgtatccttctgaggtaacaggaaaggtttgcaagcctgtcctttctcatcgatataagcgataaacggtcttgtatacaaaccatccatccgccggctgctaaacacgatccaacggctatcgctactccatgaatgatagctttccacatcgtcgctattcgccgcctccaatggataacttcgcagagtcgataaatcaatcatgtacaaatcggcatccttatgccaaatagagaaattcccataaccggacaaggtatagagcaaatactttccatccggggaaacccggggaaaagaaacgcttttatcgatctccgatgccttatataaagtatcgactaccgtcccgaaacggcgtgtagcgggatcgaacgagactgagcatagatcgtatctcacttgatcgtattccttgggcatcgtacgggctttagccgaacagaaatagagcgtatttccatccggggaaaatgtagggaaagtctcgaacgctccctctgaagacaacagcggagaagtcacgatctcatgcttttgcgtatcatagacgaccacatccgaagccgagtcgaatacctccacccgattcctatcgttcatatgaaacgcttgcttggttttattcacagagaaagcgacatattttccggaaggatgccaagaaggatagaccagtggagaaagggtctgatcggtcttcgtattcagcttctccaccctatctccatcgatcaataaggtacaagaataggtctcacgcatatggaaaagcattttctccggattctgcatacagaaagaatggcagttcatacagttattgccgctcatcttattttcgatgatcgcgttctccgtataattttccaagttacgttgatagatacccatacggttccacagctcatagcccggttcgattaagcgataagccaaccaaccatcgaccggctccttcgccaccttgatggtgaagggtgcatacgcgatccattcgttattcacgaaagcttgcacggttacattcaaatgattcccggaagcggtacgcaacagccttttccaaccggaggccgggatcacgaaacaagcgtctttcccggtcttgatctctaatttctccgggccacattcgagaatggcacgggcctcagcgcaagcgtctttcagcttaaaattcaagggagctatattcggcgggattgtcacatccgcataatccggaaagatctccggcttgacttccagattcttctgtatacgtaccggaccggaacaagccatcaagcccagaatcatccacagacatatacatcttattatatacatttttctcatctcctatttaaacatataataataccaatacgtatcgccataagagcgatacatcaaaccgggcagcgcattactattattccgcccagcgagcacttgcctcttataatcggtgaatcgccctacgatagattccgaaacaccgaaacgtttccagtaatccggatctttctccgataggatgatgaccgcctcttgaaaagagaccggtaaagaagggagtaaatccgttccgtaataggtttccaccaacgtcttaaagcgcgtcacatcttttgctaaaagatagaatacgccggcatagtggaaagcggctttattggaaggattctgctccgccaagcgaatcaagtccgtgtcgaatccatccatctggatcagatgattctcagctagcaggttcctgcgcatattccccaatagaggatctgtctcgaccgcctcatcattatacaggaatttccgctgcgctttggcccaatccttataatagaaagtattctctaagacagcgatatatttctccgcgaccggataggctccataaatcaagttcgtttgtaccaaacgttgcgtcatgcggggatttccatcacataaggcaccaatattactttcgaaagccatctcttgagccgcagcgacatttcccatcgtaaaataaacatcactcagcaaggcggatatggtagtcgatttattccatgccaccattaatccacgaggcccgtgctgcgtgtacttaaacgcctcatccgccagaatacctttccgagccaaagccatattttggtaacataaatagagttgattagtggtcggctccttgcatgataccaagatccggtcccattgctctgtccgggtaaaatagtccatcatcttcaagcggtatgatttctgttcgccatatagatcgaagcctttccagaagataagccctaagataatgaattgggagattcccagcgctagacgctttttaccagcccatgattccttgtttttacagaggcaggttacaaccagcgccgcatagaaagcgatccatgagaaataaattaccttatccggcaccaaacggaaataataataactatccggtaaaaagacaaagcggtattctccgatcaccgagtaacgcacacataatccacccaagatcaacacgatcatcggtaaaatcgcggaataataccaacggggcgtccggctcatggcctcatatccgaccatggataaggcaaacaacaaagagaccggcccggccaacccaaagagtaacagggaggcaaacagacttgctatcaaacgaggtatgaaattccttatccctaaaacgagatataaagcaagcagcatcataccgaaggcgaccgttccttgaaacctgtaattaaaatcccattgcacaaacaacaaggataggacgggaagccaagcccataaaataccatggcttcgcggatcgatccgcttcaagattgcccagaacaaggcccctaggcttgtcagcaaggctgccgttatcatagctcccacattcgggagaatgaagaactgcaccaaacaaccggagagaaccatcactaaacctcccggttgcattaacttatcgataataaaaatgggagttaactggaataactggttctgctcgacacagtaaaaatggtactcactgaatatcctcaagaagataaacagaaagacaaatacgattacattcaaggccacgccgctatacttcttcatgatatcaggttcttcaaataaaaacccggatgtacgcaatcgctacatccgggttcctattcatataaatatatgccttatttagattgaagaaacacggagcgtgttcaacaaatcccggttaataggcttatcattcttgatcgctttagagaacggtacatagacgatctggtcgttctggatacccatcatcacgttacgttgatcatccaacaaggcatcgatcgcagccacacccatacgagtcgccaagatccggtcttgtgccgtaggagaaccaccacgctgcaagtgacctaaaatagagacacgcacgtcgaactgcggatattccttcttcacacgctcagcgacacccatagcgccaccggttacctcactttcggcaaccaatacgatactactgttcttggacttacggaatccattctcgatcatctcggccaattggtctttttccaaggagatttccgggataatagcggcttcggcgccagaagcgatcgctccgttcaacgccaagaaacccgcgtcgcgccccataacctccacaaagaacagacgatcatgcgaggtagcggtatcacggatcttatccacgcattccatgatcgtgttcaaggccgtatcataaccgatcgtcgtatccgtgccatacaagtcattatcaatcgtacccggcaatcctacgatcgggaaattaaactcctgagcgaaaatacgcgctcccgtcaacgttccgtcaccaccgatagcgatcaaggcatcgatcccatgctcttgcaacttatcataggcctgttttcgtccctcgggagtcttgaactccacgcaacgggcggtcttaagaattgttccaccgcgttgaattatattactgacattttgtgtcttaaactcttcaatctcatctaggatcaaccctttgtaaccacggtaaatacctttcactctcattccgttataaatagcggaacgtgttaccgcacgaatagcggcattcattcccggggcatcacctccggacgttaaaataccaacacactttactgtagacatagcgtcattgattttaatgttctccggcaaaagtagtaaatatttagttatccttctgtctttctcccggaaagttcacgtaatcttaatcaaaatatcattccgaagcattcagttccttgatccggaccgccacttcctccatcaaccacttgggagtggatgtagcgccgcaaaccccgacccggcgcacgccctcgggcaaaggctcggtaatctctgatacctcggaaataaaaagcgtattcgggttcgctttccggcactcctcgaacagcatctttccgttggaacttttacgaccggccacaaaatagacccaatcgtggctggaggcgaacgcttttatattcggaagacgattcgccacctgacggcaaatcgtatcgtaataattaaactccaccccttccgccatccgctgcttgatctccgccactaccgccttgaatccatccaaggacttcgtggtttgggaaaacagactgatcgcacgggtaaagtccagacgatcgaggtcttctattttctcgataacaatcgccgtaccttccgtctgccccaccaagccattcacctccgcatggcctttcttcccatagataaccaactgggtgttattcgcccgggtctcttgataacatttatggatcttgcgctgcaaacgcaagacaaccggacaagtagcgtctataatcgtgatattgtttcgcttcgctaaagcataggtagaaggtggctcgccatgcgcccggagcaacaccttccggtctctcaactttgaaaggccatcatgatcgatcgtatgcagccccatatactccaaccgctccacctccaaactgttatgaacgatatcgcctaggcaatacagcgtatccgtattacccagctcccgctccgcgctttctatggcggtgacaaccccaaagcagaatccggaatctttatctatctcgacttctatcatatctataatatcattaacaaacaagcacttacagttttcttaattttcaatcacaagaaactaaagtttcttcataacaaaactagagttttccctaagagaaacttttgtttcctagtaacgaaactatagttttcattcgaagagacaaaagttttctttataggaaactccaagcactcgtttatgaaccgatcgctttatgatattgttccagcaaccaagccttttgctcttccaaggtcatatgggaattatccaataccaaggcatcatcagcttgtctcaaaggactttcctcccgggttgaatctatataatcccgcttcttcacattctccagcacttcctcgtaagaagcggggatccccttcgcctctagctcatccacccggcgcttggcacgtacctccggcgaggccgtcacgaaaagcttcaactccgcatccgggaatacgaccgtaccgatatcacggccatccatcacgatgcctttcgccttccccatctcttgttgcttagcgaccaacgcacggcgcacaaagcctagagtggctaccggactcactttatccgccacttccatgccacggatctctttctctacattcacaccgttcaaataggtatccggccggccggtctccgcgttcaaacgaaatgaaatatcgatatcatggatagaagccttcagctcttcctccttaatcttctctccctcaaaaaatccatgctggatgcaatacaaagtcacggcccgatacatggcacccgtatcgatatacgtatatccgatctccttggcaagatcttttgccatggtacttttgccactggaagagtggccgtctatagcgataactattttcttcatatatgtatatattaatgtataggtttattctgtcaccttcttaaaatcggccaaggtcgtagatacgctaatcatcatcgacatggcggacggatgatatttcgccagcgagaagcccacgtcaaacatcttgatccttacgcctgcgccagccgagaagccggagaaacttcccccgcctttcaacttcatatccatattgaccttcggattgaatcctacgcccacccaaaagttctcggacgggataaaatccacgccaatgataaaatgcttcgccaacgtcttaacgaaagaatccccgccatactctttatccgtattatcgatataatcgaacttccaacggttcaagtattgggccgtcaaagaaaaacgaatcggggcatgcgccattttctgcgtgatacccatctggatatcccaaggcatcttttgtcgctcatcctcgtaagctttcagttgcgcgccgatattcttcaaggcgaaaccaaaggaaaagcccttatccgaattataataactcaatcccgcgtccacgcataaaccgatagaggtataatcagccaagcccgaatacaagaacttcaacgacaatccaccccgccaacgctcgctcaagtcgcgggagtagaaaccatttacgctgatatctttcgccgaaagactcgctccggtcacgacattatccggcaacacctcctggatatcgccatagcttataaacgtagcgcctacgccccaagcccctttctcgccatgcgctttcgtgaacaaggcactccctacgttgatatccgagatgtaattcatataattcaagttgatcatcccatccatctccgcgcctagcaacgccggattatggaaaataagtgaaggatctctttctaccaacgccacggtatgcccacccaaggcgttagcccgggtcgaggtcggaaaacgtaagaaagtatacgcctcgctcccgttttgcgctgagacagacagtgtaacaacgaataaaatcagtataaatagtttatttctcatattttcaagcaaaaaatcgttcaaagatacattaattcggaaaaatgtttttactttacacccgcaaatctcagaaatacggatttcacattaacagaaacgggaaaaatgccaaaaaggtatataatcgctctcatttttgtttgatatatgaaataatttgtatttttgcagaagtgaaaaacacttataaattattataaacgtatggaaattaaaaaatcaccgaaagcggaccttgagaaaggtaagaccctaagtatccttatgggatttgtagtgggcttagctgtcttgttcgtgggcttcgaatggagcacccgcgatgtaatggtcgttcaggctagcgagggtgtagcagacatcatcgctgaggaagaagtggaaatcacgagaccggagaatacgcctcctccacctccaccacctccagcaccagttgtaaccgaggttttgaacgttgttgaagatgacgttgaattggaacagcaggatatcttatcatcagaggatgaccaaacctcagcgcaggaggctgtttatactccccccgcagttgtagaagaggaagaagagtccgcacaacagatctttacagttgtagaagaaatgccgaagttccccggtggagacgcagaattgctgaagtttatcgctaaatcaatcaagtatccggtaatcgcacaggaaaacggtatccaaggtcgtgtaatctgcgcattcgtggttaaccgagacggatcagtagtagacgctgaggtattacgtggtgtagacccatcattggacaaagaggctcttcgtgtgatcggtaccatgcctaaatggactccgggtaagcagagaggtaaaccagtacgtgttaagtatactgtgcctatcacgttcagattgcaatagtataacattaaacatatcaaaaaggctgcttcattttcgcagcctttttttatttcataactccattaattgatacagctatgttagcattcgagaatatacttcaaagaatagaaagcgagatctctcaactacaattcaccaatcctcccaagagcttatacgagccgatagagtacatcttgtccctcggaggaaaaagaatacgtccggcgttaacgttgatggcatgtaatatatataataatagtatagagaatgcgatcaagcccgctttaggtctggaagttttccataacttcaccttgctgcacgacgacctgatggatgaagctgataaaagaaggaacaaacctaccgtacacaaggtatggaatgccaatacggcgattctttctggagacgcgatgctaatagcggcttatcaattaatcggatcaacggaacacggccacctcaaacaagtgttggatttatttacgcaaaccgcggcggaaatatgtggcggccaacaattcgacatggaattcgagtctcgcatggatgtgagcgaggaagaatacatcgagatgatccggctaaagacagccgtactactggcctgctcccttaagacgggtgccctactcggaggtgcctcacaggaagacgcaggcaacttatatgcgtttggtatcaatataggtctagcgtttcaactgcaagatgatttactagatgtatatggtgacaccgccactttcgggaaaaacattggcggcgatatcctttgcaacaagaaaacattcttattgatcaacgctctcagactggccaataaagaacaagcggaagctctccgtagctggatggataaaaaagaattcgacccggctcaaaagatacaggcattcacctctatctacaacgaattgcagctaaaacaattaacagaaaataaaatccaagcctattacgacgcatccgtagagaacttaaacgctttacaagtcgcccccgaaaaattaacgatcctaaaagaggtttgtgatcatttaatgcatagacaatcctaatccatgagcttaatagacacacattgccatttatatctggaggatttcgatccggagcaagacgaactggctcaaaaagcaaaagactcaggtatcgacaccctgcttctgccaaacgtagacctgacgacgattgacagaatgcacgatttatgcgatcgatacccagagttcgctttccccatgatgggattgcatccgaccagtgtggatagcaattatatcgatatcctaaaacaaacggaatcctatctatctaaacgtacttattgcggtatcggtgaaatcgggatcgatctatattgggataagacttatttgaaggagcaacaaatcgttttcgaggaacaactgcgttggagcatcgatctaaacctgcccgtagccatccatacccgtgacgcatatccggaagttctggaatgcatacataaagtcggagcggaaagacttaagggcgtatttcatagttttaccggcacaacggaagagctggaagaaataaagaaactgcccaccttcaagatcgggataaacggggttgtcacctttaaaaattcaaaactgtccgaagtcatccggcaaacagatcttgaaaagatactcttggaaacagatgccccctatctttcaccagtcccctacagaggtagacggaatgagcctacttacatatggaagacggccgagaaagtggcggaaacattcggcctcacgctagaggaaaccgtaaacgctactcgaaaaaacacattagaattgtttaaaagcctaaataaacccatatagacactttttttcgaatgaagtcaaaatttatttcgcggatattgtgtatatgtcaagcaaaaactatagatttgtgcactgaaaagattgcatatgggaattttttcgtattttgcggtcgttttagaagaagctaggcgaataattggagagatgctcgagtggttgaagaggcacgcctggaaagcgtgtaaacccctaaacgatcgtttagactagtcgtttttttagtattatgaaagatagcaagaagcggcttttatcattaaagacatgataatgaagaagctacacaaatgaagttgagaagaagagaatgatgtttgcctattttgagatgtaaacagatgtaacataccctagaggtatggcagagtagtgaattcattttgttaaaagtctgtgttttttattttattataccttaaattctaaatttgtatgagaaatgttgtatcatggaagccattagtcttaggagcttcttttcttctgtacggagccggaactgcttttgctacagaaacagattatttgtatccaacatccagtacaggacttatgagcgtacagcaagatggacgacaagttaactgtaccatcgtagacaaatctggccctatcctcggagctaatgtagtcgtaaaagggactactatcggaaacatctcggacatggacggtcgtgctataatcgacaatgtgcccgcaaacgcagtcttagtagtatcttacatcggatacgtaactcaagaagtgcatcttaaagataaccagacctctatcaaaattacattagtagaagactcccaagccttggacgaggttgtcgtaacgggttatagtacccaagcgaagaaagacattaccggatccgtggccgtagtctctacagatgacttaaaagagactccagtatccaacttcgccgaggccttgcaaggcaaggcagccggtgtattcgtacaggctggtggcggtccgttgggtgagactacgatccgtatccgtggtgtaggctccgtgaatggttccgacccgttagtgatcgtggatggtgtatccggtgtagatatcgatgccgtgaacccgaacgatatcgagtccatgcagatcttgaaggatgccgccgccgccgccatctatggagcgaaaggagcgaatggcgttatcatcatcaccaccaaacaaggaaagaaagatgaccgtgtaaaggtttcttacaacggttatttcggtgtggccaagatggctaataacggttatgatctattggacgcatgggaagcgatggaattccaagaagaaggtcagcgtaacctgttgaaatatcgcggtttgaccacgactcacgcacagttcggctcaatcggagcagatggttcaggccatttaacaatgccttacgcactgaaacctgctggttatagtaaggatcaagtcattcaagagtttggttcaatcgacgcatggataaaatcctataaggatgacggaacaaacacatggtctcgttccgcttactaccaaatgctggaggatggttattcagaagaagaagctcgtaaaggtacaaactggtacgacgaggtagtacagaccggtaaggtgcagaaccacgagatctcagtaacaggtggtggcgagaaggctacctactcggtaggtttaggctacatgaaccgtgagggtacaatcaaggagtcttggttccgccgttattctttgcgtgcaaataccaacttcttcgtaaacaagtggttcaacatcggacaaaatacgaatctcgccgtaatagagaactccggtgagcgggggcgccaaggtgacgacaacacattcggtaagactttctccatccagccgtgggtacctatttatacggtaggtggagactatgcgggatccgtgaacaatgagggtggacgtgcggaaagtgccgtgatgtctgttaaccacggtaaggataaccgccgtcgtttcttgcgtgcgcaatccgctatctatgcggagatcaaaccattggaaagcattggtgaggacttgacgatccgtacgcagttcagtgcccgcttaagtggcgcttgggacttttggatgaacaagcgtactatcatgaccaacaaggagggacgtaacaacaacgagttctacgagaacgccagttattggttaggctaccaatggacgaatacggccacttataaaaagacaatcaacgaagaccactcaatcggcgtagtattaggaacagaagctatccgcgagggcttaggccgcgtgatacaggccggccgtattgattaccagttcgaggatgacccgaacacatggcaaatcgacaacggttctgccgccaacttacgtaacagtggttacatgcactcacccagcaccatgtttggtatcttcggacgtgctgattacgcttaccaaggcaaatacttggctaccgtgaccgttcgtcgagacgcatcctctcgattctccgagaaaaaccgttggggtacattcccttccatatctttgggatggcgtatgtcagacgagaatttcatggaaaagactcgtacatggttagacgacttcaagttgcgcgccggttacggtacgacaggtaactctaatatcggagcatacaactgggcattccgctacggtacaggtaacacgtggctctatagcatcaccggtagtgatacggacgtaatgacaggatacggtgttacggccttaggtgatatcgatgcgaagtgggaaacctctaagatgttgaacgtaggtttcgatgcgacagtcttcgaccaacgcttaggcatcaacttcgactggtacctaaagaagacctccgatatgttgatcgatgcgaactggtctgctttggctggtaacgcagacaagcctaaagtaaatatcggcgacatggaaaataagggtgttgacttgaatttgacatggcgcgacaaggtcggcgaggtagattactcgattggcgtgaacctttctcactataagaacaaattgacagagatcggtacggaagccggtatcttcgaaggtactcgtatctccaacatgaatgtcatgatgaaggggtatgcggttggtatgttccacggttatcaggtggatggtatctacaagagcgaggatgaggttcgcaactataagaatgatgctggaggcgcagtattaccatacggtacggcagacgccgcttcgttaaatccgtctcaatacgtaggtcaattcaaggtgaaagatgtgaacaacgatggtaagatcgacgcaagtgaccgtacattcatcggtaacccgcatccggacttgactggtggtgttaacctaagcgtaggctggaaaggtttcgacttgagcacttacttgtacttctccgtaggtaatgacatctttgccatgtataaatactatacacactacggttctttgcaatctgcttattcaaaagatcgtcgcgacaactcttggagcccggagaatccaaacggaatctacccgatgtgggcaaccgctacaggagaaagtacgattgcggccaacgaatctaattccagctacatagaggatggttccttcttgcgtatgcaaacattaacgttgggttataccttgccgaaagcatggatgaacaagatcaaattcgacaagatccgtatctatggtcagatctctaacgtattcacattgaccggttattccggattggatcctcaggttcgtacggatgatggttccggtaattctaaagaccgtaacatgggtacagactatggttcatacggtatgccacgtcaatttatccttggagttaatgttacgttctaaaactaggaatgaaaatctgattatattaacaattaagtagaacaataatgaaaaaaatatttatatattccgcaatggcggcagttctagccttaggaaatacgtcttgttcggattttctagaggtcaaacccgctggttcagtaagtgagcaagatttcgtgtcagcgaaaggggtagagcaattggtgacaggtatgtatgcaaaaatgcacgacaactcctatttcgaggcaacattgagtaactatgtatatggcgacgtgatgggcggtagtgccaataagggctccacgtatcaagaccaaccggacttcacaagtttggagacctatacgtttaccacagacaacggttacctaaacgtgaaatggaaaaaatgctataacggtgttttcgtggcaaacaacgtgatcaagttggcagacatggccaaagaagaaatgtcaacggtcaatggagaggcgaaagacaactatacggaaacgatcgcacaggcacgcttcttccgtgctttctggcatttcgaggttgtaaaattatttggagccgctgttccttacgtggacgatctggctatgcaagagaacgtaaacccgcaggtttctaatgtagacgagagtggtaactacatttatatttgggataagatcatcgatgacttacaatttgcgtacgacaatcttccagatcgctggactaccgacaaggggcgtataaacaaatgggccgcaggtgccttattggcaaaagtaaaaatgtatcaatcttctccatacgatggaaagaacggctcacaaaaccgttggactgaggtcaagagccttttggaggaagtcatggcgaacggtaaagacaataacggcacaaaatacaaattggctgacacatatgaggagcttcacatcgcaggtgaagccgattggactggcgagtctgtatttgatatccaaatggcaatcactggtactgtggaagaaacttccagtatcaacggaccatggcacatcggttttaacggtgcgttaggtacaggaggttggggattctatcagccctccaacgatttggtaaactcacatatcgttgacgcaaacggtctgccgatgatggatggtcagtataaaaacagccctgcgcttacgacgctagacgcaaacaacattcctcatacggatctaacggtttacaccgacccgcgtctggatgtttcaaccggacgtttcaatactccgttctgggattggacagttccttcatctttggatggttgggtacgcgattatagtaatggtggcttgtacctgaacaagaagaacatcccgcgtaaggcagacaagggtagcttgtctatcgtaacagtaacgaactcttctgcgaagaacttccacctgatccgttatgcagacgtattactatggtacgccgaggcattgattgaaacaggcaaccataaggaggccggtaaatatatcaatcaagtccgtgcccgtgccgccaacggatatgtaaaggctgccgatccgaataatggtatggcagagactacatcctcatatgtattagaggacaaggtaaacggaaagactctatcgaatgccgcggctaactaccgtatcggcttatatcccgattctcaattcgcttccaaagcatctgcgacgcaagcgttacgttgggaacgtaagattgagatggctcttgaaggtcaccgctggtatgatttggctcgctggggtatcatcgccgatgagttgaacagctacgcttcttatgaaaagaaattcttattgaaatatgcgaatagcgtttacaacgcaaaatggtgcgtattgcctattccattgaatgagattcaaaagatggacggcctcttggttcaaaatgaaaattggaaataaacaagtgggttaacattaatatcgggtaaccaggcatgtgatatgtgtggttaccccctcacaaaagcgaaaagcgaatgcttattcgcttttttcattttaaatacatatctttgtttgactttaaatcataatgaaacgtatactctagccatgagatataaacaaatactcttcggtttgatactgtttgccatattaggggttttcttgcaaataaccagcaagtttcatttcttttatatcgagcagcttcaactattccaattttccggagactatcttgcggataaaatcagttatccgggaggtttatcttcggtcatcggggaatttttgacacaattttttatcaccccttatctcggtccctttatctttgccgcattgctcactggcatagggcttaccatgagggctgtcgtaagacaaatcaccccggaaaaagagttgtatctgatttacttactccccgtcttatccttattattggctcaatacgatttcaattacttactacaaggaacagtggcctttttaatttgcctactttgtttgaatgggtggatacggatcaataactttcgattccgattatttacggccctacttatcacacctctacttttctggataggagggcctatagccggattattcacggtctgcgcattcatcaaggaattattcggccaattcaaacaaggagttgtcttcttggtgatccccatcgagtttacactcatagcgaccagttgcgtatgggcgacagtcattaccgattatcatttcgcgttcctaccggatgcctattatcatccgatcttacaagctccgaatgtcatatatttttcctgggtcagtttgccgctttcgctgatcttcgcatttacatggcctaaaggcacttcgaaaaagagagattggatagagatctccgtacaacttatcataattctcgcactttgcaggttcgggataccaagatataatgatcaaaaatcttatcaactaaaggaactagattattatgcccgaaacggacaatgggatcaaatcatccggaactgccaaggtccgatcaagaattacttatacttgacttacctaaacaacgcccttgctgagaaaggcgagttaggaaaccggatgtttgcgttcgatcaacacgggcctcaaggattattagcctcttggaataagacttcttccgtatcgaccttacttagcgacgcctattttacgcttggagaaatcgccttatcgcaagagatggcatttgaaggatatgtcaccgtgattggggccggtaatccccggaacctacaacgtctagtccaaaccaacttgatttacggtacatatccaatcgcagagaagtacatcgatatattagagaagacttacgcttatcacgactgggcaaaacgacatagggaatttctatataatgataaagccatagaagaagatccggtactggggattaaacgaaaaggacttccccttcgtaacaacctttccggtgtaaacgggttagaacatgatttattgatccgggcagaacaaaacccggagaatcagattcccatccaatttgtcggagccatctatcttttatccaaggatatgaaatctttccagacattcattgagaaatattacggtacatctacacttccttcccttccgacgagtttccaagaagcggttattttactagccgagaaagactcggattattggagacggttcaacgtgtccgaaaatgtcatccggaaattcacaggttacaggaatcttgtattgcagaaccggaataacccacagctaccccaattgataaaaaactcttttggagacacctattggtcttattaccttcttaaatgattcattgccatgaaaaagcactatctatatattatatgtgtatgttttatcgtactggggatattttcatgttcagacacggttccggtaagcaaggaaacctctgagaaaccgatattatacccagattacgcagatgtaacgataccgaataatatcgctcccctgaattttaaaatacagaatgcacatacggaagcgttcgctgttttctgttttgaggaagtgaagttgcaggtgaaagaaaaaaaggggcaattccatattcctgccgccaactggaaaaagctacttaggaaagcgacaggcaaaacgatacaagtaaaactttatgctaaggataaggaatggctgagctatccggaattctcgttgtttatcgcacaggaacctatggattcctatctagcctaccgtctgatagagcccggatatgaactttggaaccagatgggtatttaccaacggagcctggaaacctacgaacaaagtcccattatggaaaataaacacagtggacaaaattgcatgaattgccattcattttgtatgcaaaaccccaacaagatgttattccacatgagagataaatacgccgggacttatttgatagacggagataaaatagaaaaattaaatacgaaaacggagcaaacaatttcccccttggtttatccctcttggcatccctccgggaaatacgtggcattctcggtaaaccaaacgagccagagctttcattccaatgacaaaaacagggtcgaggttttcgatagccaatcggatgtagtggtgtacgataccgagaaacatgagatcatcagtactcccgctattcgtacgaaagaggcttttgagacattccctaccttttcccccgacggaagaacgctttatttctgtaccgccgaggcacgttcgatgccccacgagtattcggaggtaaagtataatctttgctccatagcgtttgatccggtaacaaggagtttcggatcaaagatagacacattatataatgtacgagagaatggaaaaagtgtctcttttccccgtgtctctcccgacgggaaattcttgttattcaccttatcgggctacgggaacttctctatctggcataaagacgctgatttatatcttctggatatcgagagtggttttttccatcccttacgaaacgcgaacagcacagacacggagagttatcattcgtggagtagcaacaaccgatggatcgttttcagcagccgacgaatcgacggattatatacccgaccttatttcgcctatatcgacgagagcggaaatgcctccaaaccgttcctattaccacaggaagatacggatttctaccaccggttcatgaaatcatataacatacctgaatttatcacaggaaaagtatcatctaacatacggaaaatcagcaaacttgccaaagaaagcaagggggttgacgttacttatcataaatagatcgaatctgggaaacatacataaagtaaaaagaacatgaataattcaagcaaaaagatcatacctattcttctgctcttattgtgcacctgccttctggggttacatttacaagccactcaagaagcaaccttcttctaccgggaacaacagcagatcttcctattcgatagtgaatatgtattgaatatacttaagacaattggaggattggctacgatttgttcccaatttattatacagttcttcaaggtgccgctgatcggatcgctggtgactgcattgatcggtggaatctccggttggttattctggctgaccttacgaaagatacatccggcattatatcttatgcccttggcctttctccccatcctattccaatatctttacctaatgaaagatagctatcattatgaaggactgatagccatgttgttttggtcattggcgcttaacgtatatagttacagcgcacgaaaatttaattggacgtaccgtaccttaatcggttgcttgctggcgaccggattgttttacccgatgggatctgtagctatattattcgcccttagcatcttactatttgatatattacaaaaaagcgaacgctggtacgcaagcttcatccctttgatcctgctgcttatcgtaggttctctatgcgttctagggggcagtaaacccgattatgactatgtattttggatgaaagattacgtagagtatttcattgatctggaaccattctacggtttctcttggcaagtagcgttactcgttatgcttctattctccctatcacgttattagatcacataaaaacctatttaaaagctttagtagccgtagcattacttgccttatccggtatgtattatacgcaaacggctcttcaacagaggaataaagatttctatacgttgatgcaaatgtttcattacatagataccgagcaatgggacgccataatctcgtccaccgatctgaactataataactatttacacctgaattgcttaaaccttgccttatcccacaagggtgtcatgcagactgatttattcaaatacccgcaaagcggaatacaatctttggtctcaaagtaccaagcgcatatagaggaaagtttcctgttcagccagatatactaccatgtaggaatcacgtccttggcatacaatttcgcttttggtacctcggtaggaattacatacggcagtcccgtcatgactaaattattaataaaatcccatttgatatacggacagtatcccgcggccgagaagtttatatccttattggaaaagacatgggcctatcacgaatgggcctcctcgcaacgaaagttcttatataatgaccaagcggtggagagcgacccggaattaggtacaaaaagaaaaagcctatccagcgacaaagaccttttcgccaatataatcggattgtttgataacctgatgattatattggaagagaatcccctgaataaagccgcattggattatacgatcggtacgttattattatcgaaagacctgctcgctataaaaacgtttgttgaaagattcagtaggacggaagtactccccgcattacccgaacccttgcaacaagccgtgatctcttatgcggagcatgatccggaatattgccgcaagtatggggtaaccgataaagtcctgtccgagttctcgatattcaagcaacgtgtattgggactaaggcatgcccgacaaaatgtagcgactggaatagccgactatcaacctactttctggtactatttgatactctctaaataaaacacatatggaaagacagacttacacaaatacaaaccgatatcttttcctttttctcatcgccttgatggtttcatgctccaaaagcgacgtacagatcgccaagagtctaaacaaggaaatcgccatttatccggattacaaggatgtgaccatccctgtgaacatcgccccgctcaatttctctatcgccgatagcagtgagcactgccttatcattaaaggggaaaagactcaactccaagtctatagcgatgaggggctctttgagatcccacaaaagagatggaaagccttattgaaagagaatgccggaaaccaaatagaattgaccatcgctaaacgcatacagggcgaatggaacgcctatacgccttttcatatggacatcgtaaatgattccattgataaatatatagcctatcggttattagccttgagcaatgatatgtggaacaggatgggtatctatcaacgaaacttggaaaattatgaccaaagcgtgatttatgagaataacctaaccgactataactgcgtaaactgccacacgttttcctccgggaacccggataaaatgattttccatatgcgaggcaaacacgctggttccgtactgattgatggaaagaaaatcaccaagctaaataccaagactcccgagaccgtctcaaactttgtctacatgtattggcatccgaatggtaactatctggcggccaccgtatgcgatacctaccaaaacttcttcatcaataatcccaatacgctggaagtattggatcataactccgatatcgtgatctacgacgtgaagaagaacgaggtattctcttgcgaagcgttaaattccaaagacgcatggcaaatattccctgcgttctctcccgacgggaagagcctctatttcagttcgaccgccgccgtagattctatttctaagaatttcagacaaatgacctacagcctatgccgtgtcgactttgacccggaaacccgcactctaggccagcaagtagatactttatacaatggccgggccaaccacaaaagcgtatccttccctagaatctcaccggatggtaaatatctggcttttaccctacaggaatatggcggtttcggggtttggcataaagacgccgaattatatatgatccgcctatccgacggaaagacgtacccgctgaccgaggcgaacagcgccgaaggagaaagctaccattcatggagccgcaacaatcgttggctggtatttagcagtcgcaggttggatggattatacacacgcccgttctttacctatatcgatgataaaggcacggcccataaaccattcctcctgccacaaagaaatcccgtaaaatattataaagacttgttgtggacttacaacctcccggagtttatacaagaaaaggtccaagtagatacgcatgccgtgatggaaaccatgagaaatacaaaaggaatccaagtaaaataagaacaatagctagggtgggcgaaaggagataaggatgtctgtttggttaaatctacccacccttagctattgatctgtttgctcactcttttatcttcaccgagaatagaaatagagcgtttcaaatcaacgcccatatttccatttgttgtattcataaaataagtacaaactttcggcaatcagatttcactctttagtgaaacaaacatatgtaatctgcgtttatagattatcaaatgtctctttaaaaacttgagacaaaaataaactattttgatagaaaaataggtctgtaaatattcacattttattcacaacacacaccaaaacgttcatttatcctaggaagcatcacaatttaacatctaaccgctccatcatcactccggtcttctcccttgcctccgtcacatccaaaccacgagccaacaagacggccatacggcgatgtccatgaacttccggttttccaaagaaacgcatctgcgtatcgggttgttccaagaccttatccagattccccaaagacaaccggtcactgtccccttccactacgacggcacgggaagctcccgctccatgaaacacgatattagggatcggcaagccaagcaccgcacgggcgtgcaaagcgaattgagacaaatcttgcgtaatcatcgtcaccattccggtatcgtgcggacggggggaaacctcgctgaatatgacatcgtctcctttaatgaataattccacgccgaaaataccacgtccgcctaaagcctcggtgatcttaccggcgatctcacgggctttcgctttagcggcaaggctcatggcttgcggttgccaagactcccggtaatcaccgtccacctgaacatgtcctacgggttccaagtaagacgttcctccgatatgccgaaccgtcagctgggtaatctcatagtcgaaatccacgaaaccttccacgatcaccttacccgctccagcacgtccgccttcttgggcgtactgccaagcacgatcgatatccttttcctcacgaaccacgctctgtccgtgtccgctcgagctcatgatcggcttcaccacgcaaggcataccgattaccttcaccgcttccttaaattcctcctcggtctcggcgaaacgatacggcgaggtaggcaagcccagctcctcggccgccaagcggcggattccctcacggttcatcgtcagccaagtggcacgggcggtaggaatcacatggtatccctcttcctccagttccatcaaagtacgggtagcgatcgcttccacctccggcacgatataatccggtttctctttctcgatgatctcccgcaaggcatcgccatccagcatggagaccacataggaacgatgcgccacttgcatggccggagcgtccggatacttatccaaggcgattacctccacgccataacgctgcaactctattacaaactctttccccaattcgcccgagccacaaagcacgactttagttgccgtagccgatttgggcgtaccaattgttaccataaatctttctgctatttgaatttcgccgcaaaggtaagggtttagataaagatagcctagggcttttttctttatctattaagtggaagaagcagagagattcattatctatcagttgttggacgatcatgcaccaactgttggatgatcgtctaccaattggtgcatgatcgtccaacggatggtagaagatgtatacatatagtaccggcacgtaaagttaccgcacgtacaagttaatagatatagatggtagagctaaaccttttcgatcaaaaccttttgttaatattacataattataagtaccttgcgatacaaggtatcttagtaaagcatatatttgtgaccaaatgataaaagtgttcaccaacagtgtaacttatttagcaaactgtacgtctaatatataaagtaactacataatatgatgattcaactgagaggaataaacaaaacgtactttaatggagccccactgcacgttttgaaaggtatcgacctagatatagagaagggagagatggtatccatcatgggagcctccggttccggtaagtcaaccttattgaatatcttagggatattagatacgtacgacacgggcacctatcaattaaacggacagttgattcagaatctcagcgaaagtcgtgccgccgagctccggaaccgaatgatcggcttcatttttcaatcttttaacttaatctcattcaagaacgccatggagaacgttgccctcccactctattatcaaggggtcagccggaaaaagaggaatgccatggcgctggaatacttggacatggtgggattgaaagattgggcggagcatatgccgaatgagatgtccggtggacagaagcaacgggtagcgatcgcccgggccttgatagcgaaaccccaagtcatattggccgacgagccgaccggagcgttggatagcaaaacgaccgtggaggtaatggaactactacgcaaggtaaacctagaagggatgaccatggtgatcgttacccacgaaccctccgtagcggaggctacagaccggattatccgggtaaaggacgggttgattgaacgtatcgaaaaagaagagaatcatgtttgactttgataatttcagggaaatatggagcaccatcaaaaagaataagctccgtaccttcttgaccggcttctcggtctcatggggtattttcatgttgatcgtgttactgggggcgggaaacgggttgcgcaatggcatcatgtacaacttcaggaatatgtctaccaaccgggtcgaggtatggacacgctataccaccaagccttggaaaggtatgcaatccaaccgcagcatcagtttcaaggaagaggacctaggcgccttgaagagagacttcaaggaggtggatctttgctcggctacgatctcccacaatgacacgatcacttacaacgaggaatatgtgacgggacaaaccaatggcgtatatccggatcatgccccgatcaattacgtgaatgtagagacgcataacggccgcttcatcaatgagcaggacatgagggaccgaagaaaagtaatcgtgatcagtccccgtatggcggaggtcttgtttcgtgacgagaagccgctgggtaaatacgtgaaatgcgggaatatgatgtatcaagtagtcggcgtgtacaacgatgatgacaaaagcaataacgctcccgcttacatcccattctccgtagcccaattgctctataataaaggatacggcttcggatcgctaacgtttaccttgaaaggggtgactaccgaagaggagaatgaggctttcgaggaaagtttccgggaatggatggcacgccgccaccaattcgacccgacagacaagaacgctatcggtatgtggaacatggcgaatgagttcttgatgtggaataatataatgaacgggattaccttgtttatctggattatcggtatcggaacgttgatggcaggaatcgtgggagttagcaacatcatgctgatcaccgtacgggaacggacccgggagttcggcatacgcaaggcattgggagctaaacccggctcgatcttggcattagtaatcgccgagtccatcctcgtaacagccgtcttcggctatgtcgggatgatcatggggatcgggctcacggagctaatcaatcacgcgatggaaatggcccaagccggagcccagtccggtgggaatatcggagaagacacgacggtcttccgtaacccgaccgtcaatctggcgatagctagctccgctacggtcttgatcatcgcggccggtgtattggcgggttatttcccggcacgcaaggcggtgaaagtcacggctatcgaagccatgagaacagaataatcataaaaaagaaaagaaccatgtttgacatagacagatgggtagagatatgggtgacgatcacccgaaacaagacacgcagcttgttgacctgcttcggcgtattctggggaatcttgatgttggtgattctattgggagccggaaacgggatgaagaacgccatgttctcgaatatcaacggattcgccacgaactccgccttctttttctccgaccggaccagcgaatcatataaaggctttaacaaggggcgtcaatgggacatgcgaaaccgggacgtggagagcatccggaaacaggtgaaggacatcgaggccgtctcccccatcatctggggaaatcgctcggacaagaatatcgttttcggccaattaagcggtacttataacgtaaaaggcgtgcagcctgattatttcaagatcgagacccagcagctttattacggacggttactaaacgagatcgacgagatcgagaaacgtaaggtttgcttgatcggcgccaaggtgaacgaggtattgttcaagggaagtgatccctgcgggaaatatatccgggtaaacgggatttactaccaagtggtaggcgtcacgaagcaacgagcctctagcgtcaatatcggcggacgggccgaggaaagcgtattcctccctttcagtaccatgcaacagacgctgaaccaaggggatatcattcacttcttgtgcgtgagcgccaaacccggctataagatcgatccggtgatcacgcagatcaaggatatcgtaaagagccagaaccagatctctcctaccgacccgcaggccgtgacggtgatcaacttggcggctcagttcgagaccttcaatatgctatttatcggtatcgatatcttgatctggctcgtgggtatgggtacgttattggcgggtattatcggtgtaagtaatatcatgatggtaacggtcaaggagcgtacccgggaaatcggcgtacgcagggccttgggagcgaaaccttggaacatcatctcgcagatcatgagcgagagtctgctacttacggccttagcgggtttgttggggttaagcgccggggtattcctgctcgatctggtagataagatcatgagtgcccagccggcttccaacggaaccatgatggagcatccggaggtaagcatccagatcgcggtagcggccacggtgatcttattattcagcggtctgctggccgggctgatccccgcatggcgagctatgcagatcaaggcgatagatgccatacgagaagaataaacaacaattgtcaattaataaaactatataatcatgaagaatcgcattgtaaaaaagatcctgcgtatcatcttattagtacttgtgggagcagcggtaatcggtacattctatttcttatggaagaaagcgcaaccggtcatcaccgtttatgagatcgtaacccctgaaaaaggggatgtggaaaccaagacggtcgctaccggaaacgtagagcctcgtttcgaggtggagatcaagccgcagatttccggtatcatctccgagctgaagaaagaagcggggcagatggtccaagcgggagagattatcgccattatcaaggtaatccccgagatggtacagctcaacagcgccgaatcgcgcgtgaacctcgccaatatctctttgaagcaagtggaagagacttataagcgggatacgcaattatttaagcaaggtgttatcgcccaagaagatttcgatctttccaaagcgaactacctgaaagccgtggaggaaaaggataacgcgcaaagtgccttggagatcatccgcgacggtatagccaagaactccagcgtggccagtacgacccaaatccgtagtaccattaccggtatgatcttggacatccccgtcaaagtaggtaactcggttattcaagcgaataatttcaatgatggcacgacgatcgctaccgtagccaatatgaacgacatgatcttcaaaggaaacgtagacgagaccgagatcggacgcatccacgagggaatgccgatcaaattgaccgtcggcgccatggaaagccgttcattcgacgctttgctggaatatgtatcgcccaagggagtagacaagaatggagctattcaatttgagatcaaggcggccgtaacaatccccgaagatgctttcatacgtgcgggatatagcgccaacgccgaaatcgtgctaaaacgtgcggaagacgtgcttacgatcccggaaagtacggttgagttccaaggggattccgcattcgttcagttagttaaacaagagcaaccggagcaagtcttcgagaagcatcctgtaaaggtaggtctgtccgacggtatcaagatcgagattcaagaaggactggccgcgaccgataaagtccggggcgcagctattgacccgaataagaaataaaagaaagattgtatgatgagaagaaacttatatatactggcaatcgcttccctcctgtccggaaactatgttttcgctcaggatgcggtgaagcaatggagtctggaggagtgcatccaatatgccatcgagcataatatcgacttaaagcaaaaggagcaggaacaggaaagccgaaaggtagacttacataccagcaaatacagttggctcccggccctaaatggtagtcttggacagagcttccagttcggacgctccacgtctaaatccggggtgatcgtggaccagaacgccgccaattccacattggggatcaatctggacatgcctttatttgacgggttaaaaataccgaacgatatcgccgcccgcaaacttgatctaaaagcgtctatcgagaacttgaataaggcgagagaagacctatccatcaatatagcttcctactacctgcaagtactttataataaagaactactgaaaatagcgcaactacaagtgaaactagacaaggagcaggtgaataaaacggaggccatggtgaacgccggaaaggtgcctctttcccaactgtatgatatcaaggcccaattagcgaaagatgaggtcacgcttaccgagtcgcaaaacaatgtgaacctcgctttactggatctggcgcaaagtctggaactagagcgaagcgatcggagtttcgatatacagactcctgtaattgaagatgcggtggctgataatatgagcagtatcctacctccggaaaacatttacgatcatgcggttacgttcaagcctcagatcaaggaacaacagtatttgctagagagccaaaagaaaatgttgcgtgtcgcgcaagcgggctattaccccaagttaaatttcggggctagttacagcaatggatattatcattctacttccggaggtgaatttgccgatactcgttcctttagcgagcagtttaagcagaatgggcaaaagatcgtcggattctcattgagtattccacttttcaaccgcttccaagtacgcaatagcgttcgtaccgcaaggatcaacattatcaaccgggaattgctgatggaaaatacaaagaaaacgttatacaaggaaatccagcaagcgtactacaacgcaacggcttcccaagagaaatatacggcttccgacaaatccgtcacggcgagcaaggaagcgttcaattatgcccaagagcgttacaacgcaggtaaaagcactgtctttgaatttaatgaggctaaaacaaaatacgcgcaaagtctagcggaacaggcacaggccaaatatgattttatcttccgtacgaagattctagatttctataatggtaaccctatccgtttataaacgttaattaatacttcatttttttcattatacacacaaagtttaagggaagatggtctttatggacatcttccctttcagcatccattaaggcatttagtctgcacagaactatgtttaacagcataattaacagacagatagctaagaccaaaaaccctcctgccagctatcataatgcaacaagatccccagtacaactaaattgaatttggcaatatcaatcaatattatattagttttagaatgttttataacagtttgcttttttataataaaaattagtatatttgcggctgtgattttcaggagtcttggtgtgtacatttttttgataagtattttaactgtagttctgtgcagactatggtctctcgaaaaaataatgtgtgtctaattaacaaacaaattcattctatgaagcacaaattaacgcttgtactactctcattctttctgggaatacagtgcatggtcgcccaacaaatgaaggtgacgggtgtagtgatcaatgaagacgacggagaacctgttatcggcgcatccatcgtagtaaaaggaaccactgttggtaccatcacggatcttgatggtaaattcgaattggaagcagacaagaacgctaagttagttgtttcttatgtcggtttaaaaacattagaaaccaccgctcaagcaaacatgagagtcattctatcttctgatgctcaagaacttgacgatatcattgttgtagcttatggtaccgccaagaaatcgtctttcacgggttccgcaggtgttgttggaacaaaagaccttgatatgcgtccattgacaaacgcaaccgcagctttggaaggtaacgtatctggtgtacaagttggtactggtagcggacgtccgggtgattccccaaatatccgtatcagaggattcggttcaattaatgcatcaaacgctcctctttatgttgtagacgggtctatttataatggagagatcgctgatatcaacccgaacgatattgaatcaatgtctatcttaaaagatgcagcctcaacttctctttatggttctagcgctggtaatggtgttgtattaattacaacaaaaaaagcaaaaaatgatgatactcaagttacattcagtacttctcaaggtatctcttctcgtgcaatcaaggaatataaccgtgtaggtgtatgggactattaccctttgcagtgggagatgcttcgtaaccagtatatctccgcaaatggcatgtccgcaacagatgcggcaacagaagcttctgccaaaatttataaccaattaatgtataacccataccgaggggttgctaatgatcaaatcgtggggacggacggaaaattaaatcctgcagctacccaattgttatggggagatgatatggactggaatgacgcgatggaacgtacaggctatcgtggagaatataatttgtcttattccaccaaaggaaagaaaagcgatacttatgtttcattaggctatttaaatgataacggttatgtgatcaaatccgatttcgagcgttactctgcccgtgcgaatgtaaatgtgtatcccgtgaaatggtttaagacaggtttaaacatttcagccagccgttctcaatctcaagtagccaacacaaaagataattcaggaggttattcaaaccattttatgtttgctcgtacaatcggcccgatctacccgatccacaaacatgatccggaaacaggtgcttatatcttggataacctaggacagcagcaatatgactatgatggtgtacgcgcaggttccgcttattcgggccgccatgtagtagcagagacattatggaacaacgatgagtttgtacgtgacgtaatgaacgcacgtgcttatatggattttaatttgtacgaaggtctgaaggttacattgaacggaggtttggaaacttccaacaaccgtaattccggctatgataataaattagtaggtgacggctctccgagtggacgtttcaaccttgaaaatacccgccggacaacaacaactttcaaccaattgataaactataataagaaattcggagatcataactttgatgtattattaggtcatgaaagtttcgcttacaaataccaatataactacacaatgagacaaggtcaagttatggatgggctgatggagctaggaaactttacaacaataaattctgcctactcttatacggacgaatacaaaaaagaaggttattttgcccgtatcaactatgacttcatggataaatattatgtatcagcctcctaccgccgtgatggtagctcacgcttccacaaagataaccgttggggtaacttctggtctttcggagcctcttggcgtatagaccaagagagcttcatggagtcgttgacttggatcaacagtttgaagttaagaggttcttatggacaaaccggtaatgaccaagtattaacaaccagtggactaacaaactattatccatatcagactttatatgacatgaaccgcaataacgcattggaagcaggtgtgttattcaactcttttggaaacaccgatttgcaatgggagactcaggtttcttctgacgtggcaatcgaatttggactgttcgatcgtttgacaggtagcgttgagtatttcaacaaacaatccaaagacctgttgttcaacgtacctctacctctttcttctggagcggtagactataaaggaaccgcatctatctggaaaaacattggtaaagtaaataatagtggtgtagaaatctccttggattaccgcatcttaaaaaatgcggattggacatggaacttcggtgtaaacgccacattcattaagaacaaggtgaagagtttaccacaaaaagaaattattgacggaacaaagaaaatcatggtaggcaagtctatctacgaattctggttaaaggaatatgtaggtgtagaccctcaagatggagctgctctttatcgtttcgacgatactgtagatgagaacggaaacgtggcacaaatctgggatgacacagattgtcgtaccgtaaacggagagaaagtgacaacgaaccaagaaaaagcaaaataccattatgcaggtagtgcaattcctaaagtatatggaggtttcaatacaagcgtaaaattcaaagattttgagttatccgccgtattctcttacgcattaggaggaaaggtttataactctagctatttatctcttatgagtgtaaacaaatatggagcggctatgcatacagatatctacgatcgttggcaaaaaccgggagatataacgaatgttcctcgtctagacggcagtgaatccgctaatttcaatgcacagtcagaccgttggttgatgagttctgattatctaagcatgaaatctttaactttcgcatatacgttaccaaaggccttcctttctaagttcgctataaagaacgcacgtgtatcattaagtggcgagaatttattcctgcttacttccatgaaaggtatggatccacaacaacagttcagcggtatcacgaacaatgctcatatcccagctcgttcatttacattcggactgaatttcacattttaattcatcattatattaaacattgattacaatgaaaagattcaaatatacaattctagccttatgtgttgcaggcctgacagcttgttccgatacattcatggaaacaaatccaaccgaccagattggcgaaacaacagtcgcttcatctttggaaaacctatacattgctttaaacggaacacatcgagccatggttaagcaatacttatcttcacaaggttgtggtggcgaaccttcttgggacatcgatcgagatgtattaggagaagatttggtacacccaactgccggtaacacttggtttttaaaaactcttcaatgggtagatcatcgagattcaaaatcaacattgactaagtttggcttcttcttctattacaaattaatattgaacagtaacttacttcttaataatgtagatgaggtggatcgtacggatgaaaatttatactccggtgtaaaaggggaggcactttgcttccgtgcgtttggtcattttcaactagtacagctctacgcagaacgttataaagcaggaggtggcaatacacaattgggcataccttatcgtaagactccggaaacaggagaaatcgctcgtaatacagtagaggaatgctatcaatatattaacgaagatctagatgccgctattgagttattgaagaactacgaggcaaaagaagttactcacttttctttgaaagtggcttatggcttaaaggctcgtgttttactagcgcagcaaaattatgcagaagccgcaaaatacgcggatttggcaatacagaccgctgagaaagaaggccataagttgatgaatggtaaagaagaattaatgggaggattcgcatccatgctgacagagaataaggaggctatatgggcagccaatacgcaggatgaccaaacaatctatttttattcttattatgcatatatgtcttggaatttcaacgcgtctgcaatacgtgccgtccccagatgtgtaaactcggctttgtatgataaaatatcaaatacagatatccgcaagcaatggtgggatccaacaggtaaagcggaagttccggctagcaatttcaaacgtttcccgtatcagaatcgtaaattcactgccaaatcttcttctaatgcggttggagactttcctttcatgcgcttagctgagctatacttaatgaaagcagaggcattagctcgtaacaatcaacttcaagaagcgcaaaaaacgttgacggcatttgccttgactcgtgatcctgaatacaaagaaacgagcaaaacagcagtcgaattagcagaagagatcatgattcaacgtcgtattgagttgtggggagaaggattccgattcacagatttaaaacgtttaaacttaccgttggatagaaataacactaatcacgataagggtatctcaataaagatgcacgtagacgcaggttctcctgaatggcaattcaagattccagatgacgaaatgaacgcaaacagtcttatgactcaaaatagataatcactctatttcttactaattatatcaaaaaatccccgtctatacccctaaccggtttaggcggggattttttaagatctaaaagaagttattccaaatcattaaaataaattcaagtgattaaatccatgaaaacaaactatctattctccaccttactatccttggctctagccagcccgggaatggcacaagagaccaattaccaaaggcctccagccgtaatagaagaagtggccttggccaagctttctcctatcatccgaattagtgataacaatcagtgggcactccagttagagcgttccccgtaccggtctatcgccaagcttgcgcaaccggagcttaaattagcgggaatgcgtatcagtcccgaaacattcaatacgagccggcaagccgaatatacgggtgccagtttaatgaacatcgctactcaagaagaaatcaagatagaaggaattcctgacaacgcggtaatcacagaagcctcattctctccttcatccaataaggtagctctattcgtggaagaagcggatggcgtatacctttatatctgtaccccgaaacagcccgtagcacagaaagtaagtacccgcaaaatcaacgcgacaaatggagcggagatcttatggattagcgacaatgagtttattacgcttatggttccggaaaacagggagaaggcaccagagaaacccacagtcccatccggtcccatcattcaagaaagtacaggaaaggtgatgcccgcccgtacctatcaagacttactcaaaaatccgtacgacgagcaattattcgactattacttcacctcccaattggtacgtataaaagagggcattgtgtacgagatcggaaaaccggcaatctacggcagtacactttcattatccccggataaatctttgctacttatcgcgacagttcatcgtccgtattcctatcaagtaccggtatataacttcccacaaaagttcgaggtcatagacttacaaggcaattccatttatacgttagcggataatccaaccgtcaatattccgatgggatatgacacgacctcgccttatccccgccaattcggatggagatcggatcaaccggctaccgtttactgggcggaagcgcaagataaaggagatcctaagcaaaacaagaccgatttcatggatattatctaccaaataagctatccgttcaacagcgagaaacaggaagtcgcaaagacagagaaacgtttccgcaacatcctgtggaatgacgatgctttcgctttattgatcgagacttcccgggagactcgaaaaaacaggacatttacttttaagccttgctcttctgagtctccggttctattattcgatgtatccaccgacgataattacaacaatccgggaaatccacttacggttaaaaatgcgtatggtaaatatatcgtttatatcaataaagcccacaatgagttattgatgcttgcccaaggtgcctctcctaaaggggatatgccttaccttagccgttacaatttgaaaacaaaaaagaacacggaactttggcgctgcgaggacggatattatgagaccatcctaaaggtagcgaatccggaaaagcttcaattgatcacttcacgtcaatccattacagaaccagcgaatctctgctctcgtgacttgaaaaagaaaaaattcgctcaattgactcatttcgccaatccatatccggccatggcaaacgttagcaaacaaaagatcaagtataaacgtgcggatggtttggatctaacagcgaccgtatacctccctgccggatatgataaagcgaaggacggtccattacctgtcttaatgtgggcctatccgagagaatataaaagcaaggccgaggcttctcaggtacgaggttctcaatacatgtttacgaatatcaactatggttctcccgtctattgggttttacgtggattctgtataatggaaaatgtcgagatgccgatcgttagtaccagtgagggagcggagccgaacgatgatttcattgagcaattgacaatgaacgccgaggcggccgtaaaagttatttccgagatgggtgtaggtgatccgaatcgtgtagccgtaggaggacattcctatggagctttcatgacagcgaatctattaacacataccaaactgttcaaagccggcatcgcacgtagcggggcttacaaccgtacgcttaccccgttcggcttccaaacagagacccgtacttattgggaagtaccggaaatatataatgccatgtcgccattcatgtctgccgataaactacatggagctttattaatcatacatggtgagatggataacaactccggaacctttccgatccaatccgagcgcctgttcagtgccctaaaaggccacggggcgatcgcacgttatgtcgtattgccctatgagagtcatggctacgccgccaaagagaacatattacatctattgtatgaatgtgacctatggctggatcgttacgtcaagaacgcaaaaaagtaagtagtactgactttgccaatgaagtatatatcctctgacaggaaaagtatatctcctctaaccaatgaagtatatcttctatgaggaagccagccggcagccaccaattgccctaaaacaacgatgcccatcgtaaggttataagaatgcccatcgtaaactccttacaatgggcattcttaactccttatgatgggcattcaaagaaagccctatctgagattcgtttattttagcaatgaacaaggacaaagatgatccttctcgatatccttgaaatagttataagtacctaccttaagatccgcgcaagccgcctcatcgcaaacaatgattcccttcggatgcaactgcaaggcggtaattgtccacatttggttcacggcaccctcaacggcttgttgcaacgcacgagccttgttatgaccatttaccatgatcaatacctccttagcgtcaagaaccgtacctacaccaaccgttacagaagtcttcggaactttattcacgtcattatcaaagaaacgggagttagcgataatcgtatctgtagttaacgtcttgatacgagtacgagaactcaaagatgaacccggctcattgaacgcgatatggccatcaggaccgataccacccaagaacaggtctacgccaccgaccgctttcatgcgagcctcataagacgcacactcagcctccaaatcctcggcgttaccattcaagatatttacgttctccggtttgatatcgatatgactgaagaaattattccacatgaaagaatgatagctttccggatgatctttcggaaggccgacatactcatccatattgaaagtgatcacgttctggaacgatacgacaccctgcttgttcaattcaatcaggttcttgtacatacccagcggagaagatccggtaggcaagcccagtacgaatggtttttcagcggttggattcgcggctttgatcttcgctgctacataattggcagcccattttgagagttgctcgtaattaggttcgataattagtctcataacgttatgttttttaattgaaagttgtatcaactttcttgtttataaattagatttgtcgttaattgttttcaatttcccagccatttccttgcccaaagctaaacactcctcgtatttagtagcacttaaaccttgcttctgctcaaccggcgtaccgacagtctcccacttcatcttctcgccaaaagccgccaaacgtttcacggcggctccagcccatgtgaaagacccgaaataaccgaaaatacgatttttcacttcacgcaactcgatcttactcaacacagcttccacctctgggaacaattgattgctataagtcgggctacctacgatcactcctttatatttgaacacatctttcaaaatataagaagaagggcttttgctaacattatgcatcacgatattcttaatgccattatcagccaaagaagcggcgatcgcctcagccatctgctccgtgttaccatacatgctgccataaataataaccacgccttcctcaccttcgtagcggctcatacggtcatagatatcgatcgctttcgacgcatattcacgccaaacaggtccatgggtagagcaaatcgtctggatatccaagcccgaaagcttctgtaatgccctttgtactggacttccatattttccgacaatgttggagtaatagcgaatcatctcttcccaataatgctccacattcatctccgtatcgatcacaccaccatccaatgtgccatacgtaccgaacgcatccgcagagaatacgattttatccgtaacgtcataagtaaccatcacttccggccaatgaaccatcggagccatataaaatacaagctcatgacgacccgtattcaaggtatcaccctctttcacctcaaacaagccttccttgatgccatgatatccttccagcattccaaaagtcttattgtttccgacaatctgtacgtccggatattgctgacgcaacaaacggatacttcccgcatgatccggctccatatgatttaccacgagataatccaaagaacgtccgtccaaggcatccgctacttttttcaagaaaatatcagagtaacaaacatcgaccgtatcgatcaatacggttttctcgtctacgatcaagtacgagttataggaaacgccgtatggcaacggccacatattctcgaagagggccttttgacggtcattaactcctacataataaactttatccgcaatttcttttaacttgtacatcttttttaattgataattgataattaaaaattgaaaataacaaagcgtgtgctctctaattttcaattctcaatttttaattttccatttcttagcgctctccagacaaaccagcaccctgccaaaacaaacgggatacttagccattgccccatattcaacatcattccagcctcgaaaggctcttggtcatttttcacgaattcgatgaagaaacgagacccgaatacgcatatcataaatacgccgaagataagtccttgctttttccatgcctctttcttgaaatatagccacatacagatagcgaacgtcaccagataacaagcggcctcatacaattgcgtcggatggctcggagctgtaaaaataggctccgcccccattctccatgcgtgtaaattatcgataaaacgaaatccccaaggcaaatcagtggaatgaccgtaaatctcatgattcatcaggtttcccagacgaatcatagcagcaaccaatcctgtcggaaccaccaacttatcgaaagcccataacatacttttatggcttactcgcttagagtagaaataaatggcgataattatacctaacgtaccaccatggctagccaatcctccctcccaaatcttgaaaatctcaatcgggttggctaaataatattccggcgcataaaacaaacaatgccccaaacgggcaccaatcaccgtaccgagcatcgtataaatcaaaagggaatcgatccatgcgggcggcagtccctcttttttccacatccgctctacaatcatatagccaatagcgaaaccgatcgcaaaagccaatccataccaacgaatctcccgggaaccgatggtaaagatagcgggatcggcagtccatgtaataaagtcaagcataattatttcagttggcaattgacaattgacagtcgacaatcgcaagtcaggatttcccgaactgtcaattgccagctgtcaaccatcaacttatattaaacgagtcttctaattaagttctctctctcgccgtacagcatatcgattatcggcaattcgatcatcgtatacgcacccggttgttgcttcaagctcgcacgggcgacagaaactaagatctgagcagtcaaggcagggttattgatcttcatatcgaattcgatcaactggttctgagtcttacccgatacacctttacgaaccaagttcacaccatgtcccatatccaacaggttatcaacacattcaacctgcattacatgagtctcatcatgagcgaaataatcatccgccttgatagcggcagacacttgcttgaaatcgtatccgtcttccacctcgatataaaccatacgacggtgcacgcccgttcccaaaggaatcgtcatacttaaagccgctttcacgccttcgatagccttcacggcaaccgtatgccccatactcatacccggaccgaagttcgtataagtaatacctttcggcaccatcgcttctaacaaagcacgtaccacagagtcgcttcccggatcccaaccagcagaaattacagctaccgtattatgagccttcgctacagcgtccaaagaacgacgtaaatccacgatacctccgtggatatcgaaactatcgaccgtattgatgcctaaagccagaatctctttcgcatgctcttccacgctgcgtgtaggagtagccaaaaccgctacgtcaaccttatctaacttggtgatgctatcagtaaccgtgtatgccttcaactcgtccggaatatcattcggattacgacgaataatacctgctacctcaaaatccggggcagcttcaagggcctctaacacatatttcccgatgttgccataacctacgatggcggctctaattttcttcatactctagtttttacttttcaaccaaccgcaaagttagatataatttagagctttaacaataaggaatacagtttttatatcattttcagaatgatatagatcctcactctttcacgaacgaatccggataggtagtaagttgctctacaccggctttcgtacgaatccaagtcttgaaggtgcgagttccttcgttcaattcgattatacgagctccgttaggcaaatgtatgtattccgtcggacctccggtaaaacgaccgtaagccaatagaacatcatgccagcaaaccgcataatcgtcatcatgatcatggccgacaaatacccccatcacgtccccgttttctttaatcgccgtaaataaaccggaattcaacgccggagcgcatgccttttctctacgtatgccatatagttgggcattctcatcggaagccgcttgattaaactccggcaacgcgatatggaagaaagccaaagaaggaaccggctctcccccgttattccgggtaaactccgcgcttttcttacaataccaatcgatctggtcacgcttaatataatcgtatccttttacccccttgatagttgaataggtattcgaatcgatgcaatacaagacgaaagcatccttcttcccatcggaggaacgtacggtcaaggcgtaattacccacgcctgagatttcgggaacctcatccgccgttaaactatacggtaggctttcggctactttcagcaactcctcttttgtcgccccctgctcattatcatgatttccgaaaacaatggagaatggtattttacggtcggagactgtcttcaatacattccgcatattttccaacgcaggcttgctatagataatatctcccgtaaaaatcaccaagtccggtttctcgtcatccaacacttggttcatacgctcaaaagcgatgtccgaacgagggtcttgccattttacatgcaagtccgtaaactgtacgatcttaaacttcttatccggattaaacttcaaccccggtttttgggcaaatcccaaagaactcacgccggcggccaataacaaggccccggcaaacatccactttctcacactcatcaaatctcgtgttttttgtaattaataattatttattcctttccgaaacaagcgtcgaacgcatgtgcggaaggttggaaatccactctcttcaccaattcgcaagattcccgtgccccatgttcccggtccatagcgctatcttcccattccacggaaagcggacctttatagccaattgaattcaaagcacggataatctcctcaaaattaatctttcctcgtcctaagctacggaaattccaatatcgacggggatcgccgaaagtaacatgaccgccgaatatacccacctgcttgggggtatcactccaatatacgtccttcatatgcacatgaaagatacgctccggaaactgatagatgaaatccacatagtccaccccttggtatcctagatgactcggatcatagttaaaaccgaaagcaggatggttatttaccgcctccaatgccctgcgtgcggaaaaagtatcgaacgcgatctctgtaggatgtacctccaacgcaaaacgtacacccagtttctgaaactcatccaagatgggcgtaaagcgacgggcgaaatcatcataccccttttgtatcatagcgtccgttaccggagggaaagaatacaaataatgccaaatagaactacccgtaaaacctacaaccgtatcgactcccaacatctttgccgcatgggcggtccggatcatctcctcggtagcccgttggtgaaccccttccggatcgccatctccccaaatataatccggcaagatcgccttatgacgctcatcgatattatcgcatacagcttgtccaaccagatgggtagagatcgcataaagccgtaagtcatatttctttaacagatccttgattccttgataataagctgtatccgtacgtcggacatccacatgatcaggaagtcccaattccacaccgtcgtatccgaattctttcgctttttgacaaactgtttccagtgataaatctccccactggagggtatataatgttacaggacgtgccatatatagtattatttttagtcgattatttttatccatttattctctgtcgatccggtagctacaatcgtctcgataaaccgcatgccacggacaccgtcttcggcggaagggaaatccaaggtctcaggagccggttcctcaccagccagaatcgatcgcaaagccaaggcgaaattccgatacaaattagcgaatgcctctatatagccttccggatgtccacccggtgtacgggaattatgagcggcgatacccgacatatatccattggaagtacggacgatctccgccggacgatccggccaacgcataatcatcgtattcggttcttcttgacgccattccaacccacctttctctccatacacacgaatattcaagccattctctacacctacggcgatctggctagcggtcagcacccctttcgcgcctccctcataacggatcaatgccgccccatcatcatccaaaagacgatccggcacgaaggtattcaattcaccgcataattccacggccttcagccctgttatatattccgccagattaaacgcatgagtcccaatatcccccatgcaaccagccttgcccgaccgattgggatccacccgccaagccgcttgcttattaacatcagcgcagtcattatatagccagccttgaggatattccacataaatacggcgtatcttacctaaatcgcccctgcgtaccctttccctagcctccttcaccatcgggtaagcggtataggtatgagtcagcataaacaattttccggtttccttcactttgtctcgtaattgcttcgcctcatccaaggtatatgtcatcggtttatccagtacgacatggaaaccatgttccaacgccatcatggccggaccgaaatgcacatgattcggggtaacaatagacacaaaatccatccgttcgccttcaggcagggcggcctctttctctatcatttcctgataagatgcgtaaatacgattatccggtaaaaataaagattgtccggtagccaatgaattctccgggcgagaactgaagcatccacagaccaactcgatctgtccgtctaaattagcggcgatacgatgaacggccccgataaacgagccttgtcctccaccgaccattcccattctgatttttcgtttcatggtattattccgttttattaaactaaggtaattacattgttgattcacaaagctatgaaaaataaccctgcgtacgccaatttaacagcttaatattttttaattcacaaaatatatcgttcctttgcgtcaaacatttaccaaaaatatcaactatgaagaaaaatgaattagtggctatcgcctgtctgctttgtttttgttgttgtaatggaacggaaaaggaagtacctaaccccgacctacaagaggaattatcccccatacagtttacgatcgatttacaaaaggaagtattacccttccccgtaaccaagagtattcccgagctgaatatccctgagcctattccccaaaatcccgatgccgaggaagatccttctacaccggatatcgatccggataatttatacaaccggatcgattatatcgtataccaaagcggaaaaccggacattctggtaaaacataagcaattcacgcctcaagatccggatttcacgatcatttatgattcactgccctccggcaactatcatatttgtttcctagcccactcagacaagaatatctccgtgtccggacaaaccgcactattcagtaaagtatcagatacgtttcatctttttctcacccaagaagtacaagcgggagaaagaatcattaaagatatcaccttacaaagaatcgtcggcaaaatagagttcatatccgccgatgccgtatctaaagccctaaaaagcttcacgataaatgtctccaattatcaaaacaagattgatttaaccaccgggaatggcatttctcaaaacacgccttatacacaaaccgacacttttaacgactctgatatcgggaaaacaaatttctcccattccttcttcacgtttatcccggctccggaattcatgctcaaagcacacctctcggccaaaaatcagataaatgaagtaacccgggaaagagaggttaatgacatcctgcctctcaaaaatcacattattcgttatactgggattctctacaccccgaaggaatcagacgataccttcacccttgatatattaaacggtggcaaatgggatagccccatcgacaaagatctaaaagattaatacaaaaccggtgtgccaaatttgacacaccggctacctttttcctaaccttcacacttattttgcgtcttctatcttgaagagagcgttaaatcccgtcaaactaaaggtctcacgaaccacattccgcataccgatcaaacgtaaagaccctttcttggcagtcgtcattttttgtaatattaaaaacaatcggaggcccgcactactcacatattccaaatcagaacaatcgacacatacttttactcccggattctcccataccgacaaaaccttttcctcgcattcgcgagccgtattcgtatccaatcttcctttgatcttaattacagtctcttcacctttttggtcaataactacttccatatctttatattttattcggttatttttttcttcatgataaagacattccgctcatctactctctgataagagacctcatccataatcttcttgatcaagaaaatacccaaccctccgattggacggtcttcggcagataaagtaatatcagggtcttttcttaaagtcggatcgaaagcaatcccatgatctatcaaagtcacgatcaattccccaccttccctgaccaacgaaatgtctacggcatcctcaacatctcccttatacgcataaaaaattatatttgagacagcttcttccatcaccagattcaggctcatcatgaaagcggtgcttaatcccaattcttctccagcttcttccaagaactcattcatcatggaaagctcatgaatatcgttcttaatgcgtaatgttttttgcatatatctgaaaattttgcgctaaagatataaaaaaaagaaacatcctttccttaaatttgtatctttacctccgaatagtatttaaaggtatagagttatggctaaaagatatttaataaacatattcttattgatcgccgtcttatgcgggttcagtagttgcgaggaggatccgtattatgatccgtatgaggaaatcacctatgatttatgtaattatgtatggacagattggtttgtcgtagacggcttggattgtgagcagcaacttacatttaatccggatgggaaaggatgggatacaagaatttatcattacccaagcggacgcatagatcgagaggaaattccattctactgggattgggacaattactataccgatatactttatatggactatgaagacggacaaacggtcttgaaggacatatggataagcggccgaacttttgaatgtcaatacaatggcgaatgggtaacgtttaaagcctattaaatgatactcacctctgttgcggtcatatcaagggtattatccaatccgcttggtaatgttttccaaaagcaattaaccaatcggtataatcaccctttattaatcaacttcttgacattcctactattgagcgtattctgtatcatcccggcgatccaagttcgctggcttgagctgcctttcgaattctggaaatattgtattctagccggaatcgtgggagctaccgggaatggattcttagtaaaagctttacaatgcggggatctatcggtactgggccccatcaattcctacaaatccgtagtaggtattattgtcggtaccttcttattaggggagattccaaacctatggggtatcgcaggaatgtcactgatcgtatatgggagctattatgttttggatacgatggatgagcatttttccttggctcttttaaaacggaaagagattcaataccggatatgggctatggtccttacagctatcgaggcggtctttatcaagaaaatcatcttatattcatccaccaccatctcgttcattgtttggtgttggtttggcgcgattttctctttcgctcttttattcgctttcaaggtccatcttgtcaaagaactcaagcgaatcaaaatacgggatctttcctcctacttttatttggtcctttgtatcggcaccatgcaatacaccaccaattacgtattcgatcatatggaggtaggttacgcattggccttgttccaactttccacgatcgtaagtatcttcttaggataccgtatattcaaagaggaaaatataacgaagaaattgattggctccgttatcatggtagcgggatcggtcatgatcatcttattaaaataatacattgagcttatttacagatcaaccgttctatcttatccttaagcggaaatagatctgtttgaatggttccccacacaagttcagcgagtacctgaaagtagcccgtgtaaaagaggtatcaggcgtatcctgtggtgacgaggcgttaaagaatattcttgatacgtatggtcatttgatcgatgaggaacgtaaacttctttccttggcatccggggcgggagatgaggctacggtcgctttgatgagcgattatctgaaagaacaagagaagttggtttggatgttagtagcatattcaacttgcgattgcaagaagtaaaaaaggtgattcattgcgtttggagaaggtcggaagtgattccggcctttttctgttggtgccaataggggttttttattgtttcatgtcttattcatatatgtcgttcgattattttatcaaaataaaaagtatatgaaaagagttgtattatttgcgatggtgttaatgttgggtgtaatatcggtacaagcccagtggtcggtagttccggaagcgggtatgacagtgatgaaggcgggtccaatggttgattggaaaccgagttggaagattggggtaggagtggaatatcagttgaagccggaatttctctctctgaagtctggtttgtattatacgcaaaggggatatagtaatgacaaatttcccggatgtggatatgggtgttattggtgggcagtgccgggacctacttatgatccgtatggatatgcgtatgattactcaaataaggtgacacgaaatttcttgcaattaccgattatggctaatttcttattcaaattagctgaggatattcgtttgaatgttggagtaggcccttatatagccgtaagcgtattggataaaggaatgttcgggggatggtctgtcgcttcggaagaatccgctaagttttatacccatgatccctgtgaagggcttcgtgcttttgattggggtataagtgccactgtaggtgtggaaataaaacaatgctttatcaattttggctatgatgtatcgttaggtaaagagtataagggaggatcgatcgaggcgaattaccatactttggctcttaccgcaggatataagtttaaattgggtaaatagaaacccaagttctatagtaagtcttcctgctgatcgtttaaatatagattttatctatatatgtataggaattatctgtttgacagttgtttatatttgccatatctttgcaatataagaaaaacgaaaagtataacaattaaaaaatagcagtatgaaaacattagattatcttcatttagacgcgtcagcggtaagtaacgtagtagcaagcttgaaacaattattggcggattaccaagtattctatacgaaccttcgtggtttccactggaatattaagggacacggtttcttcgttcttcatggtaaattcgaggatatgtacaacaacgacaagttcagcgagtatttgaaagtagcccgtgtaaaagaggtatcaggcgtatcttgcggtgatgaggcgttaaagaatattcttgatacatacggtcatctgatcggtgaggagcgtaaacttctttccttggcatctgaggcaggcgatgaggctacggtcgctttgatgagcgattatctgaaagaacaggagaagttggtttggatgttagtagcctactcaacttgcgattgcaagaaataaaaatagtagattcattgcgtttaaagaaggccggaagagattccggcttttttgttctatgatatttatgctctgcaacatacttaacacctttttacatatttcgtatcttgtttaaattcatcactgctatatttgattcaaatctgaaacgcaatttcaaatatggaaaacacgctaccaaatatggaaaaagtggatgagaactataaagtgcctaatttagagaagggcattgcggttcttgagtacctttccttgcggtcggcgggggaaacattgcaagatattaagtcggcgctcgatatatcgcagaccacggcttaccgtattttgaatacattggtgcggctggaatatcttaattttagtgaagacacgaaacgctataaactttcccgaaaattattgactcttggtttcagatccttgaatgaacacaatcttttagagaccgtcttgccacatttgcgtgatttacgtgatcaagtgaaagagaccgcttgctttggtgtcttgggagatgagaaagggatttttatcgaacaagcgcaaggacatcatacgttccgcttcgtcctgtcgccgggaaagccgtttgagttgcattgttcggctccgggaaaggcgattatggcttatttgccgaagacggtgcgagatcgctacctgtcctacatgacgtttacacggtataatacccggacgatcacttctcgtgaggcctatctggaggaattagaaagggttggcaaactggggtatgccatggataatgaggaggagctgagcggcgtgatatgcgtaggcgccccgatctttaattatacgggatatccttgtggggcgatctggatctccggcccgaaagaccgcttatcgaaagaggtggtgaaaaatacggtgaagacgatcaaggaggttaccgggttgatttcgaacgaactaggatttagaaaataaggaatacaaaatataccatgaacacacgaaaatacttgataaaaaactcattggtggcttgtcttgtcggctgttgcgtttctctcgcttcagccggcaacccacctttctttactacggatgccgtattgaacgcgaagggggagctattaatgacacagaaaggaacgagacatctggatatcttttcagcggacggtaagagcttgcttcattcgtttccgtttgatgagatcccgaccggattgcttccggatggggataaggtgtatgtgacgaccttcgagaagactggccgtttacaagtgctttccttggaatcgggtagggtggaatcggccataccgacaggatcgggagcctgccatccgatgttcggaccggataagaaacatatatatgtatgtaatcagttcgataattcggtggtcgaggtggatccggtgatgcgcaaggtagtccggagcgtgaaagtgttgcgtgagcctaaatcggcggtattcagcaaggatggtaaatacatgtttgttacgaatttcctgcccgcacaacgggcggacgtggatgtggtggccgcttgcgtatcggtaatcgagatggatgggtttacgaaagtgaaagatatccaattggcgaatggtagcaatgccttacgagggatgtgcatcacgccggacgggaaatatatatacgtgtctcataacttgggacgattcacggtgcctacttcacagcttcaacaaggttggatgaacacgagtgctttcagcgtgatcgatgtggcgaagcaggaattcgttggggcggtattggtggacgagccggatcgtggcgctgccggtatctggagtatcgcttgcgatgacaagcatatctttatcacgcatagcggtacgcatgaggtaagcgtgatcgatcatccggcgatgttggcgaagtttgagtcttataaggataagagccgtctggattacgacttgaatttcttgtatggacttcgtgagcgagttcccttacaaggaaacggtccccgaaattttatattttcgggagataagttgataatccctacttatttcgccgatatcttgaataccgtcgatataaatacattggaggtaacggctaccgacatgaatccgggtcgtacggaaacgccggagaacaagggcgagaaatattttaacgatgcgaatcattgttatcaaggctggcagagttgtaatggttgccatccgggggatgcccgtacggacgggatgaactgggacttgatgaatgatggagttggtaactcgaagaattgtaagagcatgttgtattcgcatgtgactcccccaagcatgatctcgggtgttcgtgagagtgcggaatatgcggtacgtgccggttttaagttcatccagttttttgagccagaagaggaaatggcgaaatgtgtggacgcttatatgaaatccttgcgtccggtgcctagtccgtatttagtaaatggggaattatcggataaggcgaaagagggaagaaaggtgtttgagaaactgaaatgtggcgagtgtcatagcggtccttattatacggatatgaagatgcaccgtatcggcgaggatatcgaatttgagaaagggtgggacactcctactttgattgaggtttggcgtacggctccttatctgtttgatgggcgtgcggctaccatggaagaggtgttcgaggtccataagcatggtatcgataaaaaggtctccaagaaagatgtcgaggcattaacggaatatgtaaactccctgtaaaataaaaggatatgaattattgtgagaaaatacattatacgatattaaacactgagccggctgagttcgcggttatggtggacgatctattgtctcaattacctcaaaacgaggtgatcatgagactggcctttttcggtactccgggtacgaatgaggaatacgtggcacgccgggttttgctgcgggagaaaatccgtcggtattatggggattgcgaaccggctttgagctatgtctcccaaccgccgctgaacgctcctttgctgatggaggtacatagctatgtgcccgatgcgcaggatcggattactttccgtcattatcaaggtgttccttatgtcttgttggagaatgcctcgggacgtttcctttttgccggcggttttcaaggggatgtactccattttggtatagagcctcagtcggtggaagctttccggttattgggggatgtgcttcgtcgggagggttttccgttgaatagcattatccgtcagtggaattatatcgagcgtataacagctttcgacggtcaggatcagcattatcaagcgtttaataacgcccggtctgatttttatagtaaaacggaatggacgaatggttatcctgccgctacgggtatcggggcgaatctgggaggtatcttgattgatgtggatgctgtcgtatttactacgccggacgctttcgctacgccgatcgataataagttgcaggtggctgcccatgcgtattcggaacaagtactggaagttgcccgacaaaagaagacgacccctaagttcgagcgtgccaagagtatgtcttttcaggatcgtaaattgatttatatctccggtacagccgctatccgtggtgaggagagcttgaagggagtaggtctggaacgtcagctacggatcacgatggaaaatatagcggaactgatcgctgacgctaaattggttaagttacgagtctacttgaagaataaatccgactacgaggaggctgagcgtttgatgaatacctacggattaaatatcccgatctcttatatgtgggccgacgtttgccgggatgagttattgatcgagatcgagggaatagcgatacgttgaaacagatagtactaacaaatatacacaaaaacaaatgagaaaaggtttgaacatgaaaatggcggctatgggattggcgttggcatctatggtcgcatgtacgggaaagacaacaacagacgctacttgttgcgccgctaacggggagggcaattgtccggaaggaacttgccgcaaagaatgcacgaacgcatgtaatactaacaatcaaaaaaataaaacaatggcttattcaaagaagtacacgaacgccgatttttataaagacggcaagttccaacaagatgtcgctatggaagcgatgaaagatatgtttgctttttacgatgttcctttcacggagttgatggcgaaagatatgtgggtgacagactttggtttgggtgatttcgagaatgtaggtatggggggtattttctggatcaacgatccggagtataagtatttcgctcacgctatctatttgttgccgggccagatgattccggaacatgctcacgtaaagactgacttcccggctaaacatgagtcttggatggtagagaagggttgggtatacaacttctctgaggtaggagacgagactccgaacgcaccggctatccctgctggacacggaccgatcaagagcaagaatttcgtggttcagaaggtcggcgacgtattacgtctgaagaaattggagacattccactttatgatggcaggtccggaaggcgctatcgtagatgagtgggcatgctatcacgacaacgctggcttacgtttcacgaaccagaaggccgctttataaaaacctctagggttatgcttcgtaattctaagggttgccgatcgtgatccttagggtttcaataaacaaccttctaaatttaaatttaatacatgaataaatactatataatggtatcactcttgttgtcgacctctcttcttgtttcggcaggtccgaagcaaaagaaggtggataactggattgacgcctcagtaaaacaaaagtctgagcttcgtgcctctttggtgaaggcgaacatgccgatcatgtcggcttggatcaaggcgaagcagaaggctgtcccgatgtccgccgatttgacggggctggatcagttggtgcttgttacggccgccggaccggatggtacggattgggattggggtacatgggcgaacgcccgtttaatcaaggcggacggtagttcggtttggttggatgagttagatcctgattattgggtttctggctcggggagtatccgcaagaatacggatttatacgggaatcctttgttgatcggcggtaagaaatacgatcatagtgtattatgccatgccaatggcgtgatggtgtacaatatcaataaggaatatgtacgcttcgaggctgaggtgggtttggccgatcagtcgacggtaggtagtgtattcttccgtatcatgaatgttttcccgaaggaggaggccgcacgtttgctagccgcttatccgaaggaattgggggccttaaacgctaatatcgatgggttggagaactggttgaccgccagtgacgcttccgccgagcgtgatattgtcttgaatctggcttctcgtctgaaagacgctgcgtatgtaaagaacgctgttaagcagatcgagacggaaaaagatattgatactcagatccgtgagtatttgaaactttatgagaaaactcaacgtatctgtaatttgcagagcgacttgagttggttgaatatggaggcgattcgtttggctttcaacgatatgaaaaagttgaaaggcttcgacgccactaaatatcaaccggttctggatgagttggaacagcaggtaaagaaaggtttcgatggcatttatagtggtgatgaggccgctttggttaatgccgagaaagcgatcgcgaataaacgtacgatcttgctggcgaacccgttcttggatggtgataaagtcttggctgcccgctttaaattaggtgtaaacgctcataaggcaatggctccggatttgggtacgcagggtaataactggagtaaccaagagtccgcccgccgtatgggcttcgacgctgatatcgtggagttgagtaatttacgcggggaggatgtacaggtacggtcgatctataaaccggaaaacggttcctctgtcgccgacttgcggatgcattgggatggtgatcgtgctatgtttacccagacgatgcccgataagcgttggaacgtattcgaggtgaaattggatggtaccggtttcaagcaattgattcataatgaggagccggatctggagttctacgacggaacctacctgccggacggacgtatcatcgccaactcgaatatcggttatcaaggcgtgccttgtgtaagcggtgatgaccctgtcggtaatatggtactttatacgccggatacgaagaacttgcgccgtctgactttcgatcaagacgcaaactggaacccggtagtgatgaataacggtcgtgtgatgtacactcgttgggagtacacggacttgacgcactattattcccgtatcgtgatgaacatgaatccggatggtacggagcagaaagcgctgtatggtagcggatcgatgttcccgaacagtacgttcgatattcagccgttgccgggccacggttccgctttcgtgggaattatctccggtcaccatggtattgcccgttccggtcgtttaatcgtgttcgatccggcgaaagcccgtaaaggcgccgctggtatggtacaggagataccgtatcgtaaccggccgatcgtggaggagattaaggatgagttggtaaatggcgtatggccgcagtttatcaaaccgactccgctgaatgataaatatttcttggtggccgctaaattagatccacaggatttatggggtatctatttggtggacgtattcgataacgtgacttgtttgcgtaaggtagagggtgagggctatatcagtccggttgccgtacgtaagacacagactcctccggctattccggaccgtgtgaaattgaatgacaaagaggctacggtctttattcaggatatttacgagggagagggtttgagaggcattccccggggtacggttaagtctcttcgtctgcacgcttatgagtatgcttacgtgaagactacctccgatcataactggcatggaatccagtccggttgggacatcaaacgtatgttgggtacagtaccggtagaagaggatggctccgctatcttcaagattccggcgaatacgccgatctctatccagccgttagacaaagacggagtggctatccagtggatgcgtagctggttgaccggtcagccgggcgaggtggtatcttgtatcggttgccatgaggaccagaaccagattcctattccgaaacgtgtgatggcttcgcagaaagccccgcatgcgttgactccgccggaaggggggacccgttcgttcacgttcgatctggagatccaaccgatcttggatcgtgcctgtatcgcttgccataatggtgagggtaaggctttcgacttgcgtgggggcaagaaggataaattaggttatggcacttcttacttgaatctgcatccgtatgtacaccgtcaaggtggcgagggtgatatggtggttcttcaaccgtatgaatatcatccgaacacgagtgaactggttcgtatgttgaagaaagggcactttaacgtgcaactgacggataaagagtggaaaaccctttataactggattgattacaacgctccggataagggttatttcaatgcgaatgtgctttcgaaggatatcatcccgtatcaaggctttgaccagatcaagcgtcgtaaagagttgacggataagtatgcgaatggcgcaggcgtggattggaagaaagaggtctccgattatgccgcttacttgaagggtaaaggtgagatcaaaccggagatgccggagaaattggctcctgtcaaggaaaaagagttgaaggtgaaaggttggcctttcgatgcggaccggatcaaggctatgttggccgacgagaaggaaacccgtaaggagattgagttggctccgggtatcaagatgacatttgttcgcattccggccggacaattcgtgatgggtagctatcgtgggcaatccgatactcgtccgacggcgaaagtgaagattgacaaagctttctggatgggtgagttggaggttacgaaccagcaattcaacgtgattttcccggatcacgacagccgtttcgtggatcagcaatggaaggatcacgtggttcaaggatatcccgctaataagccagagcaaccggtaatccgtgtaagttacaatgacgctatggattattgtaagaagctgagtgagaaaacaggcttgaacatcacgcttccgaccgaggcgcaatgggaatgggcttgtcgtgccggtagcgatcaagatttctggtatggcgatatgaatgcggacttcggtaaaaaggataacctagccgacgtaaccacgctcctgcttgccgtaagcggtatcgacccgcaaccgatgcctaagacttcttattggtacaagtactatacttacttaccgaaagaggaaggcgtggatgatggcaatttggttcaggtgggtggtaagcaatatgaagcgaatccgttcggtttgtattgcatgcacggtaacgtggcggaatggactcgttcagattacttgccttatccttacaacgagaaatcgaaagaggtttccgagtataaggtggttcgtggcggttcttatatcgagcgaccgaaattctcgacggcttatacccgtaaaggatattatccgtaccaacgtgtattcaacgtaggcttccgggtaattattgaggactaatagacaaggtctatttatagatagataacatggatgcggcaaattaatcgccgattctttcaaaaatgattaatctgcgtacatttgtcgcatcagtgttattaataaatgagcaaatgaaaactctagaaagatttatctcttcttctgtgacgactatcgtccttctattgatctacgcctttggcttggctatcgctacttttatagagaagtatcatggtactgccgccgctaaagcgatgatttactattctcctgtatttttcttactccaattcttattggtagccaatttcgtggctatcgttatcaagcaccagttacttaagcggcgtagatggggattgatggtcacccatgccgcctttattgtcatccttctgggtgcccttatttcccaccttttcggcgaggaaggaatccttcacctgcgtgagggagaggctagcgatcgtatcatgatccgtacctcggaccagactctctatcatacgcttccttttagcgtagaactcgtgaaatttaccttaacccgctatcccggctctgccagtccctctgcttatgagagtgagttgctggtacatgtagatggacagactcgccatgcccgggtatatatgaataatgtattagacgtgaaaggctatcgcttcttccaagcctcctatgacccggatgagcaaggaacggtactttccgtgaaccgagatgtggccggaaggaatattacgtataccggctacgtgattttagtgatcggctttatactttgcttggtaggtaaaaactcccgtttcatgaaattaagccgacagttgaaagatttaagatcgggcgctcgtaaaacgaccctgttagtagcgattcttctttccgtagggggcttgcgggcgcaaggtgcggccgctcccgagatgaaggaggccatacagaaatatgcgataagtccggaacatgccgctaagttcggtgcgttgccgatccaatcggtaagcggacgtatgttgccgatcaatacattttcttccgaggtactgcgaaagttgcataaatcggatcagttcggttccttgaactctgatcagttcttgttgagtgtcttggctatgccggatatgtgggtccgggtgccgtttattgccttgtctaatagtgagctggctaattattacgaccttacggataaggattgcgcctatatagaggtattcgatagtaacggacgctataaattgcaagagaagctggaagaggcctacaataaaatgccagcggagcgtacccgcttcgataaagacttgatcaagctggatgagcaggtaaatatcttccatcaattgatcaattaccagatgttaaaccttttcccgaaagaggacgacccggatcacaaatggtatgcgccgggcgatgatttatcggcgttttccggaaaggactccatgttcgttacccacattatgggctggtatttatcggaggtacaggaaggattgaagaatggtgattgggagaaagcggacgaggtgatcggaatgatccatacgtatcagcaagccaagaataagacggtagacattcgccctgagaaaatacaggccgagattaaatataatcaaatggatgtattccggcaatgtaagaaagggtacttgattttgggaggcttgttgctggtctttgctttcgtggccttattcaagaaggataaatgggttacctatacgacttgggtattgagtctgggcattttggccgtattcgttttccatatgtatgggatgggaatgcggtggtatatcgcaggttacgccccttggagtaattcgtacgagacgatggtttatgtggcttgggctacggtgttcgccgggttgttgttcgtacgcaagagtacgcttacgtttgcgttggctactttattcggggggatcatcttgttcgtgtccggcttgagttggatggacccgcagatcaatccgttggttccggtcttgaaatccccatggttgatgttccatgtggcggttatcgtgggggcttacggtttcttcggcattagctgtctgatcggcttgacgaatctggtgatgatgagcgtaagcggggagaagaacagcgtgatgctcaaagaccgggtacgggaattgagtatcgtgaacgagatgtcactttggatcggattggccctgatgacgatcggtactttcttgggagcggtctgggcgaatgagtcgtggggacgttattggggctgggacccgaaggagacgtgggcgttgattacgatggtgatatatgcgatcgtgacgcatctccgcttgataccgaaatgcaataacctgtggttgtttaattttacgtctatcttggccttctattcggtgttgatgactttcttcggcgtgaattatttcttgagtggcatgcactcttatggccagaatgacaacgtgaacgggatatttatttatctttatctgtcgatcatcctagtattgggggctggctttatatcctatcggaagagaacgaattttaataatataattgtctaactataaattgaatagatcatgagaacatttaatcacgtaggaattgtcactacagaaagtaaagaaggggcggtttataacgaaggcctgagtgtatggttgacggattacagcaagagtccgaaccggatcgagttcttgaaattcgagaaaggcagctgcttaccggagttggtacagaccaatggccatatcgcttatacggttccttgtttggaaaaagagttggaaggtaagaaggtaatcttcggcccggctgtttgcgacgagcacttgacgatcgctttcatcgaggaagaaggtatcgctatcgagatcatggaactaaaataattcgtaaatcaaaattcataaatctaaaggaggataataccatgtcagacatcaagacaaaattcataaatgatcctgagaatattacggctgagttattggaaggttatgcgttagcgtatccgaatcaagtaaagttggcggctgagaatatcgtcgtacgtgctaacccgaaaggcaatgataaggtagcgatcgttaccttaggcggttccggtcatgagcctgccttgagcggtttcgtgggagagggcatgttggattgctccgtcgtgggtgacgtattcgccgctccgggtgcccaacgtttgtttcaggcactgcaattgatggatcgtgaggccgggatcttgctggtcgtattgaaccattccggcgacgtgatgagcgctaatatggcttgccagttggctgctcgtaagggtatcaaggtgaagaaattacttacgcatgatgatatcagcgcaggtatcggggcgaatgtagatgatcgccgtggcttggccggttgtgttcctttgtataagatattaggtgccgccgccgaggaagggaagtctttagacgagttgattgagataggtgaacgctataataagaacgtggctaccttggctgtcgctatgcgttcttgtacgcatccccagaacggaggtacgatcacgaatcttcccgatggaatcatggagatcggtatgggccagcatggcgaaggtggtggtggacagaaaccgttggtatccgccgatgatacggcagcggagatggtagacctgctttgccagcagttacagccaaaagccggtgataagatgttgttgatcattaacggcgtaggcgctactacccatatggaattgaatatcatcttccgcaaggcttataaggaattagaggctcgtggcttgcaggtggtggtaagccgtatccaagagatcttgaccgtacaggagcaagctggattccagatgatcatggcgatcttggatgaggatcatatcgattatttgaataacaaacgtgcggacgcaccttattggacaaccctaggtaaataaataatatacatgaaacaacttactatcgaggccttcaaggccatgttagacaatgcgctgaaacagatcaaggcacgtgaggaggaattttctaaattggatgccgtaatcggggatggagatcatggtaccgctatcgttgccgctatgactgccgtgaataaaagcgctcagtctggaacggagttcaagcaaatgcttggtgatatgggtatggacgtgatgatggaagtgagcggatcgacaagtaccttgctcggcgctttcttcttgggtatgagcgatcatgcagagggaaccgagttggatgccgcaggcgtgaaagctatgttcgccggtggcttggcgaatgtgcaacaacaaacccaagcgaaacgaggcgacaagacgatgatggatgccttgatcccggcggtggaggctatgcaggcttgtacgtcggatgatatcaaggtggtcttgaacgccggcgctaaagcggcgcttgatggagcggaggctacggtaccgatgaaagctaattttggccgtgcccgtaactatggtgagcgttcgattggtttcgctgatagcggggctacttcttggagctgtatgttcgcttcttttgctgaggcgctataaaataatacacagcgtgagacggggcgtgccccgtctctataaaatataataatataacgaataataaatatggcagatttagatgatttaagagaaggtgcggacttcggtttaggcatcaattgtgagaaccagagtttccatgtgaagggagccgagaacttaccttggggtatgaaagaccgtttatcccgtatcttcaacccgaagacaggcaaggcggttatgcttgcttttgaccatggtttcatcatggggccgacttccggtctggagcgtatcgacttgaatatcgttcctttgattgaatatgcggattgcttgatgtgtacccgtggtatcctgcaatctacgatccctgcgaatacgacgaaaccgatttgtcttcgttcggacgctggaacgtctatccttacggatttgaatgataatgtattgatcgatatagaggacgctatccgtatgaacgtctccgccatggcggttatgttggctatcggcgacgaggcgcatgaggctaagactgtggctaacttatataaggcggtcgataaggctagccgttacaatatcccggtaatgggtgttaccgccgttggtaagcaaatggctcgagacgctcgttatttcggtctggcttcccgtatctgtgcggagaatggcgctaatatcgtgaagacctactattgtgagggcttcgagaaggtagccgccgcttgcccggttcccgtggtaatcgccggtggtaagaaattaccggagaaggaggcgttggaattatgttataatgcgattaacgacggtgcggccggcgtggatatgggacgtaatgtattccagagtacttctcctgtcgccatgatccaggcggttcatgcggtcgtgcatcaaggtatcacgcctgatcagggatatgagttgttccgtgacttagcgaaataaagaagaatgaaccaatgtgtcgtttcgctaaatgtgtcaatatgccaatgcgaatacaacacacatgatctttttttgcagggtggatcccatgtgtccatcctgctataattggcatattatctaattagtacattattatataccatgaaaatctatacttttatattatccgcatgcctgctactcgtatgttccgcatgtcatgaggtgtcgcatcatcttttattaggcggttccggctgggataagatcgccatcgtaaacaagaacacgaaagaaattgaatgggagcatcccttggaaaaaggatgggaatgtaattccgtagctgttactcccgatcggaatatccttttttcctattcgaaaggggcgaagctaatcacccgggatcatgaggaggtctggaatatctccgctccggaagggtgtgagatgcagacagcccgtgtactttccaacggtaattatttattggcgtggtgtggaaacccggctacgatcatggaagtgaacgcaaaaggagagatcctgtcgaaaacagatttcgatacccgaattgagcaaccccatgcacaattccgtcaagtaaacaagaataagcggggcaattatctagtgcccttgttcgctacctccgagatccgggaaatatccccgtccggtcaattgctgaaaagcgtgaaagtagacggtaacccgtttagcgtggctgcgttggataacggtaattatctggtcgcttgcggtgatgcccattgcttcatagagctgaatttcgagacaggagatatcgttcgcaagatgaatgcgaacgatatcgagggagcccagcttttctttgttgcccagttgctccctaaacgggacggtggtttgtatatctgtaactggcaaggccatgacggagaggctgcgaaaggacattacccgcagttgatcgagataaacggagccggaaagatggtctgggatttgaatgataacgctaccttcgggatgatctcctctatttgtccgatcgattaaagatatatccggattattaattatatttgtacacctaaattctaaataaagcatggaagagaaaaacacgaatgctactaaacgtcgaaaccctgtaacttgggtccctagtgtctattttgctatgggattgccttttgtagtgctgaacatggttaccgtactcatgtttaagggattggatatatcggatgcccagattgcgttatggacctcggttatcatgttaccttggaccttaaagcctttatggagcccgtttttggaaatgtatcgtactaagaaattctttgtcgtattgacccagttgttatccggttgcttattcggtttagtggccttggcgttaaacttgccgagtttctttgctctatctatcgcattattaggtattatagcgcttagcggggctacgcatgacgtggcaacggatggcgtttatatgaaagagctctcgccggaggatcaagccaaatatatcggttggcaaggtgcgttttacaatttggcgaagatcgtagccacgggtggtctggtttatctggcgggttatatgatgcaatattttaccgggataggattggagaaagaggccgtgatatacgcttggatgatcgttatgctgctttgtggtacgatcatgatcctgcttggtttttatcatatgaagatgttgccttcgggtgggaaagccgctaccagagaacattcgttgaaggaaagtatggctgagctatggctggtcttcaaggagttcttcacgaagaagcatatcgtgtggtatatctgtttcatcatattgtatcgttttgccgagggtttcgtgataaagatcgtacctttgttcctgaaagctcccgtagccgatcaaggattaggactaacggagcaagaaatcggtttgtattatggtacgtttggggcggcggcgttcgtgctgggttctttgcttggtggatattatatctcggccaaggggttgcgaaaggtattgtttacgctttgttgttgtttcaatataccgtttttggtatacacgttcttggcgtgtttccagcctgataatggtctcattatcgcttccgccatcgtattcgagtattttggctatggattcggtttcgtgggcttgatgctgtttatgatgcaacaggtagctccgggcaagcatcagatggcgcattatgcgttcgcttcaggtatcatgaaccttggcgtaatgcttccgggaatgatgagcggtttcgtgagcgactggctaggttataagtatttctttatcgtgaccttgctggcgatgatcccttcattcttggtagcctatttcgtaccgttcacgtatgacgataaaggtaataagttagtacagtaatattttaataggattagttatggataatttgaaaatcgtaggcgctccgctgcctaatatgccttgggaagatcgtcccgagggtagcaaagaagtattgtggagatattcgaagaacccggtgattcctcgtgatatccttccgacatcgaacagcgtgttcaacagtgctgttgtccctttcaaaggtggttatgccggtgtgttccgttgcgacgatacgaatcgccggatgcgtttgcacgtaggttttagcgcagatgccattcattggagtatctccgagacaaaactcgagtttgagtgcgacgacaaggagatcggcgagtttgtttacgcctacgacccccgtgtatgttttatcgaggatcgttattatgtgacttggtgtaacggttatcatggcccgacgatcggcgtggcttacacgttcgatttcgagaccttccatcagctggagaacgcttatctgcctttcaaccgtaatggcgtgatgttccctcgtaagattaacggaaacttcgccatgttaagccgtccgagcgacaacggtcatactccgttcggcgatatattctatagcgagtctccggatatgtgtttctggggtaaacatcgccacgtgatgtctccggctgcgttcgaggatagcgcttggcagtgtacgaagatcggtgcgggccctatccctatcgagacttccgagggctggttattgatttaccacggcgtgcttcgttcttgtaacgggtatgtgtatagcttcggttccgctatcttggatttggagcaaccttggaaagtgaaattccgctccggaccttatttgttatccccgcaaaaggattacgagtgcatgggagacgttccgaacgtagtctttccctgtgccgccttgcatgatccggagacgaaacgtatcgctatctattacggctgcgcggatacggtaacaggattggcttttggctatattgatgagattttggactttacgaagaagaattctatcatttaacagactcgagaagaacaatatacttttgttgtcgaaacaatatacttttacacacgaaagtatattgttttagaacaaaaagtatattgtttttttattaggtaaaagagtaagagttatgacaaagatacaacagtttttggcagatctgcccgaggagaagaaatccttgtttgtccctgttttcgggagcatggagaaattttatacggtagtttacttgatcgcccggaatgagcacgtcactgatcaggagaagccagatcgttatgaggatcgtttacaggtgattcgccagatacgtaaccgggtggagaaacttgtttcctcgtatggcttggacggaggggagatcgtagccgatatcgccagcgactattttgaggattatgtcaattacaaagagccggagctagacattacgaatgatgagtttatcgctatcctccagaaaatataggagataaatataattttattgtgtgatagtatctttttgattgtgaaaaagcaatcttgtaagtctaaaatgaaaaacaaaagcttgtaaggttgctttttgttttattattcttaacttgcggcatcattatttaaaaatgtaggcagatgatgcaagagttgaataacttactatcccttattgacgctcattttggaggatcacaatggtttgtttttctattactgggaaccggattgttctttacggtctatcttcggtttccgcaattgcgctttttcgggcatgcgatcaaggtcgtgcgggggaagtacgacaataagcaagacataggagatacctcccatttccaagcgttggcaactgctctttcgggcacggtggggaccggtaatatagccggtgtcgctctggccatacatctaggtggtccttctgccttgttttggatgttgatgacggcgttcttgggtatgactaccaagatggtagaggtcaccctttcccataagtatcgtgagcagacggaagatggtacgatttccggcggtccgatgtattatatgaagcatcgtttgcatatgcgttggttggtaggactttttgcggtcgctactattttctcctctttcggtacgggtagtctgccacaggtaaatagcatctcgaacgccatgttttcggcgttcggtattcagcaatatattaccggggcggttttatcggtcttgctgggattgatcgtgatcgggggaatcaagcgtatagcgcaggttaccgagaagttggtgccttttatggcggtcgtctatctgctcggtgccttcagcatattggcctataattaccagcatatcctaccttcgtttatctctgttttctcgaatatcttttccggtacggcggctacgggtggtttcttaggagcgacggttgtctgggcttttaaccgaggtgtgaaccgtggattattctcgaatgaggcggggcaaggttccgctccgatcgctcatgcggcagccaagacggaagagccggtatccgagggtatggtcgctttattggagccgttcatcgatacgatcgtgatttgttcgataaccggcttggttctattgtcatccggtacttggctgaaaaagtttgagaataagtttcagcaggcggatacggtagtcttgtccggtgcttatcatgaatcggacccggacggtaaatccgcagtgtcggagcatgtactagggaataagcccctgcctttttatacaggctccttggaggtccggaacggacagatcctaaatacggatataacgttactacacgcacgttcctttgcggatagcgtgcgggtcaaggaagggaaggaggtgttgtttagtggtacgctctctgtacgtgacggacgtatcgaattacctatgaataaagagcgtgcggtgtatttaaccggtaagtcgctgcttcattccgcccccttgtctacggaggcgtttaagaaaggttttttaggggattgggggcagtttattattccgttttccctgttgttgtttgcgttttctacaacgatagcatggtcttactacggtgatcgggcggtgacctacctttggggaacgaaatatgtccgtatttaccacgtaatctatattgtcggatttttcttggcctcgttcacggatactactattgtttggacattatccggtatcaccgtggctttgatgacgctcccgaacttgattggtatcttgctgttacataaggaagtgaaaagctctgtcaatgagtattggcgacggatgaaagagaagttatgaatgtcaataacattttttgtgtataatacgctttgtatgtgtttaataacgcctatctttgccaattgccggaatttcaggttctgggtattagttgagaagagtaatgattgagagttggcaaagttttgattgaatgaagtattttacaaggttaatacgctggatatcttcacaggagcatttatatttcttatttgccctgttatttatcatcccaaactgtgtgttcttttttacggaaccgcttcccgtcacggtcggtatcgcctcgttgctgatacctttggccttttggatgtgtgttttattagtggcccgtaaaccggggatcgtggtttggtgcctgttgccgaaggttatattagatggggggcagttggtgcttctgtatcttttcggacagtccgtgatagcggttgatatgtatttgaaccttaccagctcgaacgcttccgaggctagtgagttattggggaatatcattctggtgatcggttgcgtattctttttctatacattacctacgctggtgctcgcttgtcgttcgatacggcagaaagagaaactgcgaaatcctttccggaagaaatgggccaagatcagcctaggcatgtttgtcgtgggtttgctcctttgcttcctgtctccttcgcaagatcaccggttctcatggaaggacgatgtatatccggctaacgccctatacaatttatatttcgccataaataaggcggagaggaacagcaagtatcatattacttccgccgactttaagttcgacgccactaagccggagcaagcggagggaaaacgggagatctacgtcttggtagtgggagagacctcccgtgctatggaatggagcctttacggatacgagcgcaagacgactccccgtatggaggctttagacggattggtgcatttcacggatgtggtgacgcaatcgaataatacgcataaaagtgtccccattatcctgtccgctgccagcgccgagaattatggagtcctttacgacgagaaaagtatcgtgaccgctttcaaagaggctggtttccgtacgctcgtgatcgccaaccagaaactaacgacctcgatgatcggcgctttttaccgggaggcagatacctttatcgatatgagtgcatttaatacgggttctacgctaacctccttgcacgatgcggcgatcctgccttatctaaagaaggaactggataaagaggacggtaatcttttcgtagtactgcatacttatggctcgcattttaattaccatgaacgttatccgaaggagttccgtttctataggccggataaggcggagggaattcgtgcctcgtataaaaaggagttacggaacgcttatgataattccatccactatacagattacgtgctgggggaaatcgtggatatgttggcgaagacaaatgctccggcatccatgctttacttaagcgatcatggagaggatatcttcgatgattccagagcccgttatctgcatgcttctccgataccgacctattaccagttgcatatcccgtatgtgatctggttctcgaaggcttaccgggagtcatatccccagaaatatctggaagcgcaggcacacgagacttatccggttagcacgaacagcgtattccatacgatgcttgatatagctggcgtgcggactccggtggccgattccacgtttgccttaacgaatcgtgccttcaaggtacgtgaccgtatgtatctgggagaccatgacgacccgatcccattttggaaagtcggcttaaaaaagcaggattttgagatgatggataaatgggatatcgcttatgataggaattagactgatctcaaccgtatatgaaagagcaaagcggacatattactagcaaggtgatattaggctatattttgctgattaccattgcggtctgctcggtcgcttacatttataatatagtagagaaagtggccgaggaggacgagccggatcatcaggcacgccggaaggtgtacttggtcaccaatacgctctccctgctctatgaaagcgaggcgttggggcagttggtaggcatgccccagaacgagttccgccacttcaatcgtacgttgaataaggcccataataacatggattcgttgaggaccttggtgacggactccatgcaactcctgaaaatagatacgatcgacatactgctggagcgtaagcgatggaatacccgtcgtttgcttgagacttggcaggaagcgaacacggagcgtctttatacggagaatatcgagaaaataattgccgtccgggatacgatcgtaaacgaggtgcaggtacaagagcgggtagaggtcaagcaagatacggtggtagttccccgtaagaagcggggattcttcaagcgtctggccgacgtgttctctcccggcaaggaagataccagcatcgtggtgaacacgacccgggagatcgttactgatacgttggtgaacgcttataatccgaccgatacgattgtcagcgttctgaaaagcatccaagacagtgtggcttggcaacggcaacaactgatggatcagttgttggaaagggcctctaacttacggtataacaatagcgtgattacccgggagatcaaccagatgctccgtaatatcgaggaggaggagatggaggcgtcgctggaaagggtctataagaagcaggtattattaagggagacctcccatttgattgccggaatcgcgatcgtctccgtggtaatcgcctttctgttcctcttctttatctcacgggatatctcacgaagtaaatattaccgtatgcaactggaaaaggcgaaacaggtcgccgagagcttattgcgaagccgtgagaagctgatgttgacgatcagccacgatatacgggctccgctctcttccatcatcggatatatcgagcttttgctacgccgccatccggatgagcgtcagcaatattatctggagaacatgaaaggttcctcggatcatatcctttccttggtgaacgacctgttggatttccagcggttggagtccggcgagatggaggtgcatagcgttcccttccgtgtcccagtcttgttcgatgagatctataccagcttccagccgatagcggaggcgaaaggcttacggtttgtcttgaacctgaaaccggaggagactgggcaagtctatatgggcgacccgatccgtatccggcaggtcgtaggaaacctcttatctaacgctatcaagttcacggaagcggggcgagtcgttttacttgtctccttacagaaactgtccgctgtccattatcaactgtccattaccgtcagcgattccggtccgggcatcccgaaagaggaacaagagcggatattcggggagtttacccgccttgccgatacggaagaggcggaaggtttcggtctgggcctctccatcacccgtaagcttctgtccttgatgaacggtacgcttgctttggatagtaccccgggaaaaggcagtgatttcacgatcttgctacctcttcccttggctgataaccaatctttgccggacgtaatggcggaggctccggatgctggtgaagccgaggctttacccttgtttgaggggcaagatgtctattgtcttctggtagatgacgatcctctacaactggccttgacggaggaactcttgaagcagagtcacgtgcaggtggtaggttgtacgaatccgcataacgtcctcgagctattgcggaacaccgtattcaacgccattatcaccgatatacagatgccgacgctggatggctatcatttactggagcggatacgtacgtccggtatccccggaacggatgagatcccggtgatcgccctatctgccagtatcgccaaggagcacgagcattatctggaggctggtttcacgggtttcttgaacaagccgtttaccgccgcccaattaatctccttgctgaatgagttgctgacactccatctggaggcaaggagcgagttgaatttctcttcgttgaccgcttttgccggagaggatccggaggcctcagcctctatactgaaaaccttctcggaggaaacccgcaagagcatcgacttacttcgggatgcgttagagggaaaagaccgggaggaagcctcccggatatctcataagttgattcccctgttcacgatgctgggggccaattcattggtacaacacctgcggatcttggagaagaatgatgaggaactgaccgattccggctggtaccacctgctgggcgaggtaatcgagcaagcgcttgctatcgtgaaggatgcggagtctgccatcgggtaatcttgtggaatccggtgtggaataaatacccatccgtggaatgcctttccccatgcttttgaaataaaattccactttatagaaacaaaatttatctattacttgttaaaggataagtagttagatattcattatcgtgcgtttcgctggctttggcacgatattcgctatctatttaatgaaatcgcaagtgggcgtttctacatttaaaccgttaaaaacgaaagtcatgaatttattcatggcgaaagattaagtcctgagtattcaatttaagtctgcaaaagaaaaaggcatcctttcgaggatgctttttctatttagtttcgttacttttgccacgaaataataaaatctactgaatcatatcatggaacacgcactacaagcccggccccgtatcgaggtggtcgacgcattacgaggatttgctgttatggctattatcctattgcataatatcgagcattttaacttgtataattttccggaggctactaccgattttatgaaagccttggataaaggggtatgggataccttgttcttcctcttttccgggaaggcatacgctattttcgccctgctgttcggttttagttttttcatccagtttgataaccaagcgaggaaagggaaggacttccggcttcgtttcttctggcggttggtgctcctattctttatcggttgcttcaacgcatcgttcttcccgggggagatcttggtgctttattcgatcttgggtattgtgttgataccggtttgcaagttgagtaataaggtggtattggcgatcgccgtggtcttgatgctacagcctatggagtggggtaaattcatgtatgccctgatgcatccggaatatgtggcatccaaggaacaatggctggtgcactgtatgcggatctttccgtatatggaaggtaccagcttttgggaaatggtcaagtccaatctgtgggacgggcagctgtatagccttctctgggcttggagctatggacgtttcttccagacatcggctctctttatgctgggtatgttgttggggcgcaagggattgtttgtcgatccggagaagcaccggacgttttggacaaggacctttgttatcggggtagtttgtttcattcccctctattatctgtccctttccctacccggtttgctggagcgtaccgaagagcttcgcccgatgagcacgatcgtgtcttccttgcgtaatttctcgttcatgtgcgtattggtatcctcctttatcttcttgtggcagtggaaggcgccgcataaggtgcttcacgggcttgtgccttacgggaaaatgagcttgacgaattacctcacgcaatcgatggtaggctctttcatctatttcggatacggtttatccctgtatgacgatctgggaacgaccgccagcttcgccgtaggaatccttcttttcattctccagctaggtttttgccactggtggctggcccatcataaacaaggtcctttcgagggagtatggcgtaaagctacgtggatgttttcttgattcgttttatttatttacctttgtggttactataaataatctgagtgggtatgttgtcgattctaatcgttgaagatgatataactttttccttgatgcttaccacatggctgggtaagaaagggtttgtcgtaagatcctcgtcctctgtctccgacgctaaacggaggctgggggaggaagcgttcgatttggttatatcggatttacgcctgccggatagtgacgggatcgacttattgaaatggctgaaaagcactcatccttccttaccccttatcatgatgaccagttatgcggagatacaaacggcggttcaggcgatgaagctgggagcggcggattatatcgccaagccgctgaacccggatgagttgctgggaaagatcagggagcttgcgcacgtggaggagaaggctccggcgagagtcccggttccctcggccccggatctttatatcgaggggcagagccaagcggcccgccagctttatgagcatgtgcgtttggtggctccgacggatatgtcggtattggtgaccggcgctagcggtaccggtaaggagtacatcgcccgtcggattcacgagcaaagtaatcgtagcaaggctccgtttgtcgccgtggattgcggcgctatccccaaggaattggcggcttccgagttcttcggccacgtgaaaggttcttttacgggggcgatcgagaacaagaccggggcgttcgtggcggcccaaggcggtacgatcttcttggatgagatcgggaacctgacgtatgaggtgcaggtccagctattgcgtgccctgcaggagcgcaaggtgaagccgatcgggagcaatcaggagatcgccatcaacgtacgtctgatatccgctacgaacgagaacttgcggcaggcgatcgagaaaggagatttccgtgaggacctgtaccatcgtatcaatgagttcacgatccgtatcccggacttgaaagagcgaaaagaggatttgctcttgttcgccaaccacttcctcgatctggcgaatagcgagctccagaaagatatcatcggtttcgacaacgataccatgcaattgttccaatcctattcttggccgggcaacctgcggcagatgaagaacgtcatcaagtacgctaccttattggcgaccggccgatacatcacccgcaaggaactcccggaggaactgacggagaacctcctgtcgcacgccaacatccagctaaagaacgtggagcacgaacgagaccttatccgtaaggccctccaagagtgcggcaacaataagacccgtgcggcccagttattgggcatcgaccggaagacgctttacaataagctgaagatttatcagttggattgataaccccttcctccccttataactcagcgtattcgctacgtgcgtcgaagcaagggcaggctttccggatgtaggggcttaattggtaatggcctaggatcttagccttcggataatccctcctcaattggcggagcaggtccatgagggcgcatttttgggcgtaggtacgggtgtcggtgggttggaggctctcgtccagccccccctcgtagcagataccgacgctttggtcgttccagccggcggcgtgcgccccgatctggttcagtggacggcagcggtgtatctcgccgtcgcgggtgacgtagaaatgatagccgatgtcggcgaatccccgggccttgtgggaggccctaagggcttccaccgggaaatcacggtcgtaacgagtggcgctgcaatggattacaaggaggcgcacctccctgtaattctggtaaaaacacgaggctaccatactccgcaggcggttaagcccaacgttcccgccaaggcggtggctacggctatgattaccttgatgataactccccatacagactttttcttctcttgttccatattataaataatgaatgattaataccccgttttttcaattcccgattcctcagatctcatccgggctctcgctatcgcttcccttattctcgcttgccccatactcggtgagttccctgattttcacgtcgagtttcagcgtcgtgggagtaaggttgccggtagccctcgcccggaggcgtacgccggtgatgttggtgttggcgttgaaatcatcggcggtaggggcccccgtggtatgcaggcctacggagaagatggcgaggtcgtcgatctttacgttcttgccgtccagcagcaactccttggtgcagtttaccatgtccttcagcatgccgtggatggcgcctgtggagtaaggggtgttgtggctggccatgtgtgcggctagccccttgatgtctacggtctcgtcgcacacggcacgtgcgtaccatttcccgaaggccgtctggttcttctcgttcttgttctggaatttcatgaatctgatcataacctattgtttttgatgatgtcacaaagatacgtcgctgccgtatcgagttgcgacttatggggagttcgagggaatagggggaggttaaagggaattaaggctcacccagcgcctctacgatggcccgtaccatggcgggggagtagaggcgctcggtgggccggtagcccatgtcgtggaggcgatctgccagcccgggatagatcgctatccagtgttgtaacttgcggtgagccgccttgggagtcatggcgggcaggtaggcttgcgccagttccatccgtccgtagggccgtatcctgaatgttgtttccatacccctaagatacggaattattattgaaatacaaagggtttcgccggatatcgcatgccctttttccggggggctaggcctatataaccctaaggcttacgagtcgtaaaccttgggtttggggggcgtaaaccttgggtttgcgggggggggacccgtaagcctcgatggtagggtacgattcggtacgattacggattttcctgaaaaacacaaatccttgtatatgagcgatcaggctttctcgcggtacgatggtacgattggatccaagcgctcaccgcataaaaaacaggtctgtgtaatattgtttatcaatctattatatcaaaaacctaaaaattttaataagatattgaatcgaatcgtaacatcgtaccccagccacgcctcggaccgcttgtcagcgggctttcaatttacgctcggcctcgatgaaggtggaggttttctcgatcaccagataaccggtttgcttgccgtttcccctcctgacgcacctgaatccctgcttcgtcatcaccttgcccagctgccggaggctgagcggcctgcgaatggcgccccagacggtcagcttggcgccgatctcggctagggtgaggaagatggcgttgccggcctcttcctgcccgggcgtgggcacggcgaagtaaacggggatcaactgcccctcgctggtctcctccatgaagccctccacgtgctcctcgagcccctttatctcgtcgagatcgaaccaatgccggaagccgcctttcgagagctggtaggcttgggcgtatatcccggcgtagggaagaggatgctcgaagggcgagtcgatgctctcgatctcgaaagggagccagcggcggttgcccgaggtatcggtgaggaattgctccttgttgccgctggcggcgtaggaggcgaggcgtatgcgacgctccttgttcgtggcgtagacggcccgtacgacgatgtcgtccgaggtgatgagcgacttcagggcattcacctcacgatccggcatactgtcgatctcgtccatgttgatcagcccgaactcgcagaaacgtagcatctcatccttgtccagccgtccggaggcgctctgcttgctacggtaacgggcgaggtgagggggtatcagccggtcgatccacgtggtcttgtagataccttgccggccgatgagcaccagtatctcatggttcgtcacctcgtcggccatccatgaggctatcatggccacgaaccatttcttgaagcaggaggcccagagggactgcttggcggggtctttcacgtgcaccatgtcgcccacttgggagatatagtccgtctgcccgtcccaaggtggcagctcctctatgaactcgcgcagcgggtgtacctcgtggatgacgtcgctgctcagcacggcacggaaggtgggctggttgatgttctgggaggtcgtccggcaacactcgcagtagagcgagttggtgtcacggtctgtcatatccttccaattcgcgttgggggaggattccgtgttgcgctgcgtcttatggctgatgatatcgtagcgcaggggcttgtcccgcaggaattgctccacgatctcggtacgtgtcattttcctcctcccgtcatccgtctcgccctcgccggccgcccgtgccttccgccccccggaggtcttggtgtccttgcccttccgggcggaagggtggtgggtaaggcgctcacggcacccgaagctggccgtggcccgttggtagacggagcggacgaggagggcggggttctcgtcgcgatagtcggcgtagttcatggcgatccacatctcggtatcgctttcggacacgccgtagtcgttcagcaagtagcagaggcgcacgaggtggttatgccgttgcccctgcatgaatggcatccgccgctccaccagctctcgtgcgtggcggcagatctcgtcggaggtcaagggcgtcgtcccgccggagttccccgcggtctcgggagagatgccggaggtagtccgcaccggctcgggacgttcgccatgcccgtcgggtacgaaagccgttgccgagaggttgagataagcctccgggtcgtggcataacgagctgagatgcacgatcggctcgcacgacgggtcgtaggggagcgacgcctgctcggcgaaatattggttgccttgccggaaggcctgccggtaatcgccctcgtagcggtagagcaggtggaggccgttgcccatcgagcgatagaggagaagggtctcgggcaaggccttgagacggagcgccacctcatgcgtccgctctgcgggcaccttgtcgaagtctacttggcaaagccccgtatatcgcgttacgcactcctttcgccggaatccggcgcatacgcaggcgggcatcaaggcgggaaatgccgtccgcttcatcctcgccgtcacttcggggtcgcctttccgcatggcacgcctgtactcctcggtcgtcggtcgcagctcctcgcccacgatccggttgtatatctcaaggattgtctccattctcggctcctctttcgacacgcaagaggcgtaaacaggtaattgtagttgttccatatgaaaataaattattaattttgctcaaattaaggcctttccgcttgcttggccaagaaagtgtccctgcaggggacataatatgctaaaacattcaaaaaagaattctacatggaaaaaaccggaacatcccaaacctcccgtgcgctaaccgtacgtgtactcacttatctggaccgcctttatccccgcatgcggcataccttcgagcgggaactacatatccgtcacggcgttttcgcgcgggcatgaatggatcaactccagcccaacgaggcgctgtccctcgagcaactcatcatcgcccaccgccatatcctccgctattacgacgagaagatcgccaagggccttatcccttccgacaccgaccgccttcgccgtgaacgggagtcttggcgtaaggagttgcttgagtggctggagtaggggggtaaaagtgtgttttttattcttttttaatacggcatgagataaatattgtctatttatcaatggctttttattggatatgttgttaattatagttaataggtgtaataatatttgcctgttgaaagacttcgcgtcataataaagtctatctttgtcgttgataatattcaacaagttgattgaaatatacaactttttttcttaacggtgttatagggtaatatttaatgattaagcatatgaagagatgtgtttttacgaaagtgaaatttatggtgccgctcttgttcgcggcgctgatggccgcttgtacggcggatgtgtacgaacctaagccggatccggttccacctactccggaaaaaccagatccatctttgcctgatgatttcaatcagtctaccgccactattcaccaagtgactttaaccgtagaagtgaatgatgagtacaatagtcagtatgattatcaagtatgggtatatgacgtgaatcctttctatactgatgacgctgaaccattatatggtggtgtggctaacgggaataagccgtatgttcgcaagatgacattgcctcgagctttggaaacgatttacattatgcaaatcgatccccaaaaaggaaaatcggtgaagaacgtattagtagatccctcaatgaaggatttggcttgcgattttaaaccgggttctgccgttggtacgacaactaaatctttattgagaagttcggaagataattataattcaggaaaagctaaactgatcactgccgaggacttttttaatatggctctgaagggccggggtgatgttactttgtctgatggagtgtataagtttgctgctggaaatgatacttatgatgcgagcactctaaccttgacaggaaatgtgacattatatgtagaaggaacattgtcagtctcgattcttaaaggaagtagtggagctactattgttttggaaaagagtggtaggttgaatatccttgaggctgatggaaaaacagatggtaacaacgctaagctagtcgtgaaaagtggagcgaagttcggtgagccggatgatcttttcaaacccgcttacaaattagttgattataatctagaaaactatggagaggtaattctttcgggatatgaatcgaaaaagcatgctgttgaactaataaattatggtacgattaaggctactaatattaatatgacagccgaaagttatggtaatggcggacggatagagaatcattgtaagattaatgttgaagccggactttcgctttacaatgttagtatgtccttggctgagtccactctgcttgaagcaaggtatatggacgcgaaagaaattgagtgtgaaatgggaaaatactcgattttcagaattacggatctaggtgatgcggcaggaaactatttggcatcttttaaaagttggaataagatagtgtgtaaggattcagattatgcgttattagatttcacgcaaactaaattattggaaggtacgctttcgttggatgggaatttggagttgttggggaatttatgggaagggaatgaattttcgaaaaatctaacgttgtctggtggaagtaagcaggttgataaaaacgcttcaatcgcaattcctgcgggcgattgcacgggggctggtaatcaaggctcgacaaatcctccttccaacccggattatccgatagtggttcccaatggcacttactatacgttcgctatggaagataactggcccgcttttggtgattatgatatgaatgatttggttttggggattagtagccaacttgaactgggaagatctgggaacgtagataaaatggttttagttgttgatcttattgcggtaggggcgacaaagacattaggggccggtattcaatttgataaattatctgccactaatttcagcggggtttccgctccggtaagtttgtttgtcaataataattattttgaatcagccggaaacatagaaccgaatccttcagcggcggtgttacctttgtttgatgatgcgcattggatattaagcggatcgcaggaacggacaatgctgaatacctcaaatacctctaagacattttatccggtacgtaccatcatgtatgaattgacttttgccggtggcgtatcacaggatgatttggatatatctgctttgaacttctttatcgtgaatggcggaaatgcaaacaatcgttcagaagtacatttagcgggctatagaccgacggatagagtgaaaacggaaacaaatggttatatcgccaatgatccgaataacctagataagaagatgtggggctttataattcctacggagtttaaatatgcggcggaaaataattctataaatgatgcctatccagaattctcagagtggtctataagttcaggcaaacaatataaagattggtatgaacatcctaatatggatcatgtgtttaaaccgaaagaaactgagtaaagaataagaaataaaaacggattgcttaccggcaatccgtttttattttagtcattaatccagcatcaaactcatataagccatcctcccctgataacccatcagctgtcgtgttagcgtttggttatccatttgttccaagtcttttttggagacggggctttcgtgttgtttggatagccagaggtgaatcatgcgtttcgtgtcgatgatgcgggccatacccataggtaaggtacccggaggggtgggaggggtattgaccgtcgcttgcgatatgttattttgcagggtaagctcttgcaatagtaattccttgatctcttccgagtcgtaaagaagttccttgataaaaagctttttgtcggacggcgctgtacccgcctcaagaggcaacgcgaaagccatgccaaccaccttctcgttctcgtccaaggctgtgtacattcctccgttatctaattgcagatcccggagtattgtgatgaaatcatcctgcgagtgcaagatacaggaagggcgttcacgtaatttacggttgaaataagcgaacaattcgtcggttgtcggtacctccggttggataaccgttatcttcgggagttgaaccggcgtattcgggcggatatacgtttccacggaataatcgaatgcctcggtataaccctgttcccggtaatagtcgaatagccaaggatcggcagggatcaaggcggagatagcgacctcacgccgttccatttcctcgaatgtctcttgcaagagtcgccgcataagcccctgacccctttcttccggagccgtgcacacccccgagatataggccaccgagatctcggtacccaaataagtcatcgtataaggaactatctgcaaggcagatactattttaccgtccttctcgatggtcattgcgttctcgtccttgtaaacacgatcaaaataaaggctgataaatgcctcggaatccccgaagcaggtacgccataagtttacgatttgttgtttcttgtccataatttatttagtttgcgtaagttgcttttttattgcggcgctcttctctaatagtatggtaggctgataagaaagcttcgcttggcgcaaccccggtatgccgagatcctcctcccggttcacgtaagtatactgttccggaaggtgagaagcgaactcttggttaatcaccgtataggcaccgtcgaaattcacgtccgctttctccacgtggaccccgaacgtattatggttgatgggggccccgaaagagaaagcgataatctcgttatcaacccggagagcgccgccgatcaggcctaggctgtcaaaatgatgcaaggcataggtaagggagcgacgttcgtcattaagctcttcctcgtcattatctccattgttcgccttataccatttacattccagtttcaggcattgggggacgatatccggcgtgatagggacatactcgtacgaatattgtttcttgaaattattgatatgattacgcttggattgatatttcttgccccgtaaggtagctaaatcctcccgtaaataaatatagtcgaaataatcccgttccgggatatagaaaaagcttccgggaagtacgccttccagttgctccttggcgtcgggggtgatacccagcatgcagagcggatgtccatattttaaggaatcctcttccagcaaacggacggcacccgctaaatctccatccccgacaggcatcatataggcgaaacggctcttgtcctcgatcatgaaacggattaataaatagccatccacgatagcgaattcgctgtcatataagaaacgccaactgcacatgttcgcgaatgagaaatcacaattgcgataatcgctgggaaatgtaaatgaggttatgatctctttgtcttctaacctaatcggtttaaacggtatatccataaattttcttgtactgttttacaactgcaaatataaaactaaaatgcatgtgcgaatgtttagaatgggaataataaaggtgatataaataccatcacgattcccatcacgatttgtaaaggtaaccctacctttacatagtccataaatgtatattttccggtggacttaacgagtgcgttaggtggcgtagagaaggatgaggcgaagcatattgtccgttattttgttgtttcgggaaaaatggctaaacttataggttgaacagccattttgtaaaataggggctggagctatttttgcaatatgaaattcgcaacaattaggttaaaacgaatgttattttaatgtctaacgaaaagaagataaatcagagatgaaaaagtacgatgcgattattattggttttgggaaaggtggaaaaaccttggcggcggatttggccaaccatggatggaatgtagctgtggtggagcgttcgacgggtatgtacggaggtacttgtatcaatatcggctgtataccgacgaaagcgcttgtacattacgctcaagtgacagggtatcgcagaccttctaccttcgagcaatatgcggaggagtttaagcaggcgatcctcgccaaggagaaactgacctctttgcttcgtgagaagaatttcaagaatctggatgatcgggagaccgtaacggtctataccggagaggcttcttttcgttccccttatgagattgtcgtgaaaacggatacggactctttcttgctggaaggcgagaagatattcatcaataccggagccacgacgattattcctacgataagcggtatcgaggataatccttacgtatatacaagtacttccattatggaactggagaaactgccacggcatctggttattgtcggaggcggatatatcgggctggaattcgcttccatgttcgccggttttgggtcgaaggtaacgatcttggaggcaggggaggtgttcatccctcgtgaggaccgggacatcgccgattcggtgaagtccacgctagagaaaaaagggatcaccattcatttgaacacggttgtgcagacgattgagcaggatgttgagcgggctgcggtgatctgccgtaacgctatctcgggagataccttgcgactggaagccgaggcggtgcttttggctaccggccgtaaaccgaatacggaaagcctaaatctgcaggccgccggaatacagacgactaatcgtggcgctatcgaggtggatagtaagttgcgtaccaatatccctaatatctgggcgatcggggatgtacatggaggattacaattcacctatctgtctttggatgattaccgtattatccgggaagagctgtttggtaatggtttccggagcttggacgatcgggaagcagtggcttattccgtattcatcgatcctccgttggcccatgtcgggttgaacgagacgcaagcccgtaagatggagaaaaatataaaggtggccagcctgcctgccgccgctatgcctcgtacccgtaccatcgagcagacggatggcttgctgaaagccgtggtagatgcggataccgggaagatcctaggatgtaccttattctgcgccgagtccagcgaagtcataaatacggttagcttggcgatgcgtctcgggcaagattacacattccttcgggattcgatattcacccatccgtcgatgagtgaggctttaaatgatttatttggattaataaaataaaaacataaatatgaaaacatcaaatattggattaatcggcttggctgtgatgggcgagaaccttgcgttgaatatggaaagtaaggggttcgccgtatccgtttataatcgtacagcgccgggagaggaaggcgtggtagaccgcttcatgagcggtcgtggaaaaggaaagaattttataggaacccatacgatacaggaatttgttgagtctatcgagcgtcctcgcaagattatgctgatggtaaaagcgggtgccccggtggatgagctgatggctcaattgattccttacttatcacccggtgacgtgattattgatggtggtaactcggatttccatgatacggaacgccgggtgaaggagatggaggcgcatgggatgtacttcgtaggtaccggaatctccggaggcgagatcggtgccttgtacggaccttccgtgatgccgggtggttcgcctgccgcttggcctttggtgaaggatgtcttgcaaagcatcgccgccaagctggacgacgggacgccttgttgccaatggattggtccgggtggagccggccatttcgtgaaaatggtacacaatggtatcgagtatggagatatgcagttgatttccgaggcgtattccttattgaagaatcgtctggatctggacaatgaggccttggctcgtatctttgaggattggaacacgggagagctggatagctacctgatcggtattacggccgatattctccgcttcaaggacgaggcgggggagggctacctgctagataagatattggatgccgccggccagaagggtaccggtaaatggagcgctatcgccgctatggacgagaatgatccgctgacattgattaccgaggctgtttatgcccgtatgctttcttccatgcaggaagaacggaaaaaagcgtcctcgctttatccgaagagtggcgtgctggggcagaccttgatctcggagaaagagatcaagcaggctttgtatgccgctaagttggtttcctacgcgcagggattctctttgttgtaccaagcttctaagcgatatgattggcagttggattacggtacgatcgccaagatttggcggaagggatgtatcatacgctctgtctttttggagaaaattacgcaggcttatgagaagaaccggaatctggagaacctcttattcgatgagttctttattcaaaagatcgagtcttccttgttggcttggcggcaagtggtagccgagggtgccttgcatggagtggctttgccggcgatgagctcggggttgagctatttcgatggactgtctaccccgcattccgccgctaacttgattcaggcccagcgggattatttcggggctcatacttatgagcgggtcgattgggagcgtggtaagtttttccataccaactggacgggtgagggaggaaagacggtttctggaacttataacgtataaagacatgaagaaagcagataatcaattattagttatattcggggcgtcgggcgatcttaccagtcgcaagttgcttccctctttgttcgagttatatgttcgtggcttgctacccgaccgcttctgcatcttgggagccgcccgtaccgcttatggcgatgaggagttccgtgcggagcaacatacgcatatcttggaggcacagaagggaaagacctacgacgagggcttgatcgatgacttcttggagaatgtttattacctcgccttcgattccaccaacgccgatgaatactacaaattgcgtgagcgcatcgagttcttgcaagagaaacatgacttgccggataagatcatctattacttggctaccccgccggtgatgtacgagatcgtcccgcaatgtttgctggagagtggtttgaacaagaccgagtctccggatggtttccggcggatcatcgtggagaagccgtttggcaccagcttggagtctgcccgccagttgaacgatcatttacgacatatcttccatgaggaggagatttatcgtatcgaccattatctggggaaagagaccgtgcagaatatcttggtattgcgtttctcgaacggtattttcgagccattgtggaatcataattatatcgattccatcgagatcagcgctactgagaccttgggggtggagaatcgagggaaatattatgatggagccggggcgatgcgggatatgatccagaatcacttaatgcaattgatgtcgtttatcgccatggaatctccctctatattcgagccggaaccgattcgtgacgagatcgtgaaagtattccgctccatacgcccgtatacggtgttggatatggataagatggttgtccgtggacaatatatcggttatcgggaagagaagaacgtagctcccgactcgaataccgagacgtatgtggcgatgaaattctttatcgataactggcgctggagcggtgtgcccttctatttctatacgggaaagaagttgccggagaagtcatcggaggtagtgatccacttcaagtctacgccccatcaactgtttgtcggtcaatgttcgggaggttcctgcaataaattgaccatccgtatccaaccgaacgagagtatatccttgaagttcgggctgaaaatgccgggagccggtttcgaggtgaagcaagtcagcatggacttccgctacgattccctctcgaagagctatcttcctgacgcttacgagcgtctgttgctggatgccatgctgggcgattccaccctgtatgctcgtagcgacgctttggaggctagttggaaatttatcgatccgatcttgctccattggaaagaggagggttcgaagaacttattcttctatgagccgggcgaggacggaccggaggaaactgttattttaggtgcggaaaagaaagtctgcgcctgccaaagaagataattttatggaaataaagagatataatgagatgaaagaggcgcttcggtcgatgacggaggacatgatggcgatgattcgccgaaaagacttcgctccgtttaacctagcgctctcgggaggggagacggcgaagcatatgttttccctctgggtagatgagtataaggataagattgactggaataacatccgtttcttctgggtggacgagcgttgcgttccaccaacgagtccggatagtaattacggtcatgcgaatcatttgctttttaagcctttgtgtatcccggcggatcatatccaccggatcaagggcgagaacgagccgggtaccgaggcgatgcgttattcatgggtcgtaaaggaattcttgccgttgttcaatcaaatgcctacgttcgattgcatcatcctcggcgtaggtgaggattcccatacggcatccattttccctaccaccatggagttattgtcggatagccgtaactatgcggtatcccagcaaccttctaccggccaataccggatcaccatgacgggaccgcttatcttgaacggcgcccccttattggtcccgatactgggcacgaacaaggaacccgtaatccagaggctctccaagggttattctccttcaaacgacacgcctgccgcttatatcttatcgcatgccgtacaggctacgatttatgggctgaacccatgattttgctacatgccgagcccttcccaaaaacatgtacgtgttttcgaaaaaacacgtacatatactcctctccttggagaagatatactgcaagtaccctaggagatatacttcaccgtccaagtaagtactacttctcgtgatatcctattagtatatacaagactgttgcccacatttaaagtgaatgtatttgttggattcatgtttttttgcgaagtttgttgcttgaaaagtaagctttgagacatgaatatgagaaatattgtattgtgtatattatatttgtttttggtgccgatgggagggtttgcccaatctgaggtcgttgtcttgtatcccgatactgaaaataaggatttggatgaagctgtataccaaaaaatctttttggccggcacgatcgatatggggaaaagtgtggattggcagaaggctacctgtgactggttccgggcgcttccggagggacggtatctcttgttcaatcctcgtagggataaagggttgagcggggagatgtccgattttgagcatcaagtgaattgggaactggagcatctggagaaagccgatctgattatcatgaacattctggcgagcagcaaatccccgataactttattggagatggggctgtttatgcgctcaggaaagttgcgggtgatttgcgagcccggcttttaccggtatgataatgtgcgcttaacttgtgcgcgctatggcatcccattgtatcagaatatggacgattttttgaaaaccatgcgctaatctattattatttgtttaactttgtatagttttagggacggtgtggaatcgatcctaagcgaatattgtcgaacaaaatggaaagaatatgaaaggtatagttttagccggaggatcgggtacccgcttgtatccgatcactaaaggagtttccaagcaacttctacctatttatgataagccgatgattttttatccggtatccgtgctcatgctggcggggatacgggagattcttattatatcgaccccgcaggatttgccgggctttcgtcgtttactgggcgatggctccgattatggcgttcgttttgaatatgccgagcagccttcgccggacggattggcgcaggctttcatcattggagagcgctttattggcgatgactccgtttgcttggtacttggcgataatatcttttacggacagagctttacccgtatgttaaaagaggccgttgacaaggcggagaacgaacaaaaagcgaccgtgttcggttactacgtaaacgatccggaacgctatggcgtggccgagttcgatgcggatgggaacgtcctcagtatcgaggagaaaccgaaggaaccgaagtcgaattacgccgtggtaggattgtatttctatccgaacaaggtggtgggcgtggccaagaatatcaagccatccgcccgtggagagctggagatcactaccgtgaaccagtggttcttgaaggatggggagttgaaagtgcagctattgggacgtggattcgcttggttggataccgggactcacgactcgttgtctgaggcatctactttcgtggaggtgatcgagaagagacagggactgaaggtggcttgtctggaggagatcgctttcaagcaaggatggattgatgagaagcgacttgagcaagtggctttgccgatgattaagaatcagtacggccagtatttgatgaggttgattaataagtagaagtagttcagaatacgagatatcgatggaaaaagacagtaaaatatttgttgccggtcaccggggcttggtaggctccgccattctgaataatttgcgtagcaaagggtatacgaactttctgcttcgtacgcatgcggaactggatctgacggatcaagccgctgtgaacgagttttttgccgctgaacggccggactatgtgttcttgtcggcggcgcacgtcggcggtatcatggcgaacagtctgtaccgtgccgattttatctacaataatttgatgatccagaataatgtcattcatgcctcttggaaaaacaatgtaaagaaattattattcttgggaagcacctgcatctatcctcgtgaggctccgcagccgatgccggaggattgcttgctgacatctcccttggaatattccaacgagccttatgcgatcgccaagatagcgggtatcaagatgtgcgagagttacaacctgcaatacggtacgaactatatcgccgtgatgcctactaacctctacgggccgaatgataatttcaatctggagacctcgcatgtgttgccagccatgatccgtaagatccatctggcgaaatgcctgcatatgggagattgggaggccttgcgtaaggatatggacactcgtccggtagagggcgtgtctgggaaggcctccgagccggagatactctccgtattggataaacagggtatccgtccgggcgaggtggagctgtggggaaccggcaagccgcttcgtgagtttttatggagcgaggagatggccgatgcttctgtttatatcatggaacacgtggatttcgaggatgcccgccagaaggagggcgaggtccggaatacacatattaatataggtacgggtatcgagctttcgatccgtgaggtcgccgaactgatccggcgagagatcgggttcgagggcgagttgaggtttaactcgtccaagccggacggtacgcttcgtaagctgacagatgtaagcaagttgcatgccttgggttggcgccatacgatcgagatcgaggagggcgtgaagcgactctatgaatggtacttgggaattgaaaaatgagaattgaaaattgaaaattagagaaatgggcaaagtagcgttaataacgggtattacgggacaggatggggcttatcttactgagttcttgattaagaaaggatatacggtacatggtatcaagcgtcgttcttccatgttcaatacggatcgtatcgatcatttgtatcaagacccgcatgtggaaaaccgtaatttgattctgcattatggcgatttaacggatagtttgaatcttacacgtatcattggcgaggttcaaccggacgagatctataatctggccgccatgagccatgtaaaagtaagtttcgacactcccgaatatacggcgaatgcggatggtttgggcgtattgcgtatcctagaggcggtccgcttgctgaacttgatcccgaagacacgtatttatcaggcatctacatccgagttgtatggcttggtgcaagaggtgccgcagagggagactactcctttctatccgagaagcccttatgccgtagcgaaactatacggttactggattacggtgaattacagggaagcctatcatatgcacgcttccaatggcatcttgtttaatcacgagtctccattaaggggagagacattcgtgacccgtaaggtaacccgggcggtttcacgtatcgttttaggtatgcaaaaaaaggtttatatgggtaatctttcctccaaacgggattggggacacgcaaaagattacgtgcgtgccatgtacgctattttgcaacaagatgaaccctcggattatgtcattgctaccgggattactaccacgattcgggactttatccgtatggcttttgaggaaattggcgtgggaatccgctttaaaggagaagggatagacgaggtcgctatcttagagtcgatagacgagggattgttcgtcaagaaggttggtgatgcctatctggaaaactttaagaaacgtgtgggtgaggaagttgtaggagtagatccgcagtatttccgccctacggaagtagagttgctgatcggtgacgctacgaaggcacgtactcgtttagggtgggaaccggagtattcattagcggctttaattgaggatatgatgaagaacgatataaaactaatgaagaaggagtcttatctgaaagaggggggctataaaattttgaactatttcgagtgagttcgaaacaatttgaagattttatttgttgtaattacaaaaagagttaattttgtgccaattttaagatattaggtaattgattgtttaattaaaatgttgaaaatatgaagactaaggttttacttttagctttgttatcaggttttgtattctctgtggcagcacaggaatatcaaccgcaggtggggttcagcaatgaggctggttataagactaatttcaagaagaataaagctcgcgacaattggtttatttcaattgcgggtggagccagcgtattgttaggagaccaaaatggagaggctgatttcaagaatcgtttaaatttcgctccacaagtatcttttggtaagtggtttaatccgtatttaggattccgtacccagttaaatggtggtattatccacggttttgaaggtgatggcgcacagtttatgcaacataataaatatgtagccgctcacgtagatttgttgtgggatgttactaacttctgggctccttacagagaatctaaagtgttccgcttgattccttgggtcggttttggttatgcgcagcgtttcaagactacagagtcttatgatcgtccaagaacggagtctcctacgttgaacgctggtatcttaaccgctttccgtttgagcaaacgtgttgatttgaatgttgagatccaaggttctttgttgaacgagcagtttaaccgtgtcgagatgaatcacctgacagatggtatcgttcagttgagcgctggtttgacattcaaattgggtaagactgacttcgaggtattggagccgatggattacgctttgttgaacgacttgaacggccagatcaactctttgcgtgctgctaacgatgagttgagcaaacgtccggtttcttgccctgagtgccaagagacagttactgaagttataaataactacgttgacaatgtggtttatttccgcatcaacagcgctaagatcgacaagaaccagcagatcaatatctataacacagctgagttcatgaagaacaacaacgctccgatcaaggtagttggttacgctgacaagaagacgggtacttctgattataacatgggtctttctgagaaacgtgctagagcggtcgctaaggaacttatcgataaatacggtatctcttctagccagatcactatcgagtggagaggttcggacgaacaaccttatggcgaaaatagctggaaccgtgtagtaattatgagcgctaataattaatttacgaattaatactttaaaaaggccgtacttctaagtgcggcctttttttttgcgccgaaaaatacttacttttgtgagaatttatcgaattgctatgatattgaacaaaaaacatggttatttaatccaatggctgattggtgtaggagatttgatcgtattgaatctcttgtttatggccgtttttcatctgcttggcccgaaatacacggaagcgatatcctataatttgagagaggttattttgttattgaatttctgttatttcttctctttatattttatcccgattcaattgcatcaggcggtcgtgtttatcgacaagattgtgcaacgggcgttcggattggttaccgtacttatctttttattcgctacttgcttgatcttcttgaatgtaggggatattctggctaccttcctcttggtctattacggggtttctatcatcttgttttcactttggcgggtttttgtgcgcttatccttaaagttttataggcgaaaaggctataactttaagaaggtggtgattgtgggtgcgggaaagaatggtatggagctttaccaagttatgaaagatgatttgagctatgggtttagtgtaaaggggttctttgatgacaatgactcgttgaaagacgttttacctaattatttgggtaagacgagtgaggtggaagcgtatgtgctggagcatgatatcgatgagatttattgtaccttgccgggtacgaacaacggaaagatcgtacggcttctgaatttcgccgagaagaagatggtgcgtttctatatcgtgcccgagttttaccgggatgtaaagaagagtatggtgatggaggtgatggaatcgatcccattgctgacggtccgccgggagcctttgcaatccgcctataaccggttcttgaaacggacgttcgatatatttttctctttggtgattttgctcacgatttatccgatcctgtacatcgtggtcggtataatgatcaagttaagctcacccggcccgatcttgtttaagcagaaacgtacgggattgtatgggcatgacttcgaatgtttcaaatttcgtacgatgaaggtgaacgcgcaggctgataccttgcaggccgttaagaacgatcctcggaagacccggatcggcgatttcttgcgccggacgaatctggatgagttccctcagttcgtgaacgtcttgctgggcgatatgtccgtggtaggccctcgtccgcatatgttgaagcataccgagcagtactcggcgttgatcgataagtatatggtgcggcatttggtgaaaccgggagtaacggggtgggcgcaagtcaccggttaccggggtgagaccaagacgctggagcagatggaaggacgtgtgaagagagatgtgtggtatatagagaattggacgtttttccttgatttaaagattattgtggttacggtactgaatatgttcaagggagagaagaatgcgtattaatccgatttgttgcacactttttgcggatttgtgtaatctgtatttatatttatgctatattcgcgctcgatgggaagaataattgcaatagattacggccggaaacgtacggggatagccgctacggatattttacaaatgatcgctaacggcgtggcgacagtcccaagtggagaggttgtgaaatacctgtcggattacatatcgcgggaaccggtggatttatttgtggtcgggcttccgaagcaaatgaacaatgagccttctgagaacatgaagtatgtggaggcgttcgtgacccatctgaaaaggacgataccaagtatcccggtaacttattacgacgagcggttcacgtcggtcttagctcataaggccatgttggaaggcggtttaaagaaaaagaaacggcaagataaaggattggtcgatgagattagcgccgttattattttgcaagcttatttagaaagtaaaaaatatcagttataacttatgattttacccgtatttttatatggtcagcccgtactaagaaaagaggctgaggatgtacctaaagattatcccgacttgaaacagttggttgccaatatgtttgaaacgatgtataatgctgatggggtagggcttgccgctcctcaggtgggcttgtctatccgtttggtggttatagacggtgatgtgatgggagatgacttccctgaatgcaagggtttcaagcgtgcgttgattaatcccgagtttttggaacgtagcgaggaggaaatagctatggaggaaggctgcttgagcctgccgggtatacacgagaaagtgtctcgctcgaaaacggttcgtgtgagatattgggatgagaattgggaggaacacgaggaagtggtggaaggtttcgccgcccgtatcgtgcagcatgagtgcgagcatctgacggggcatgtctttatcgacaatgtctccgctattcgccgtcaattgaacaaaggcaaattaaatagtattattaaagggacggttcgttgctcttaccgggcaaaagccgttggtaaataataaatctataaataatcaatatgacagatttaagtaaaaacattgaggccctcagggaaaagaaagccgttatcgagatgggcggtggtgaggctgctatcgaaaagcaagtggcgatgggtaagcttactgcccgggagcgtatcttggctttgttggataagaactctttccatgagtatgacatgttcgtgaaacacgatggccgtgatttcggtatggagaagaaggttctgccgggtgatggtgtggttaccggtacgggtacgatctttggtgccccggtttgcatctatgcacaggactttacggttgccggtggttcgttaggtttgcagcatgctcgtaagatcaccaagatcatggatcatgcgttgaagatgaaatgtccgatcatcggaatcaatgactcgggtggcgcgcgtatccaagaaggtgttggtgctttggctggttatggtgaaatattctatcgcaatacgatcgcctcgggcgtgatccctcagatttccttgatcctcggtccttgtgccggtggtgccgtttattctccggcgttgacggacttcgtgtttgtggttgagaacatctctaagatgtttatcacgggaccgaacgttatcaagaccgtgctgggtgaggatatctctatggaagaccttggtggcgcacgtgttcatgcggagactacaggtaacgctcatttctatgccttgagcgagcaagaatgtttcgatcaggtgaaacgtttggttagcttcatcccttggaataatcaggagcgtgcgaaagtggttgagccgaaagagccgtccgctatgctgaatatcgagcaagtagttccggcggacccgaaacaaccgtatgatgtgcgagacgttatcagatgtatcgtcgatgactcggacttcttggagattcaagagttgtgggccgctaatattgtgatcggttttggccgtatggcaggagaaacggtaggtttcgttgccaatcaaccgatggttctggctggcgtgcttgattgtgatagcgctgacaaggccgctcgtttcatccgtttctgcgactcattcaatattcctatcatcacgttggaggatatgccgggttatctgccgggcgtagatcaagagcatgcgggtgtgattcgtcatggggctaaggttctgtatgcgtattcggaagctactgttcctaagatcacggttatcttgcgcaaggcgtacggtggaggttatatagctatgaactcccgtcacttgggcgctgacttcatgttcgcttggccgagcgcggagatcgctgttatgggtccggaaggcgcagctaacatcatattccgcaaggagatcatggaggcggaagatcagaacgctatgcgtcaggagaaggtgaaagaatatatcgagaaattcgcgaacccgtacgtggcggcttccaagggatttatcgactctgtgatcgaaccgaaagaaacccgttcattattgctacacgcactgaagctttccattctaaaagaggaatacagaccggccaagaagcacggtttgcctccgttctaaattgatgagagtatggaaaagaaacaccagcaagaagaatatgtagactttgtggtgacggcacgtaaatataagacgttgctgacagcgaagtataagagccgaccgatgtggcataagccgtcggctggtgacgtggtttctcatcttcccggaacgattatcaagattatggtagaagaaggacaggctgtggaggccgggcaacttctgctaatccatgaggcgatgaaaatgcagaaccgggtggtcgctcccatatcgggagtcgttgtcgagctcaatgtaaaagagggcgataagataacgaagaatcatttaatggtaaaaatagagtctaagtaagataatttacttatttttgcctctcaatcatttttaataggatgaagaaggcaacactctttttgatattacagatatttacgatttcgctttttgcgcagattaatacggaccgtgtattggccattggcaggaacgccctttattttgaggattatgttctttccattcagtacttcaatcaagttatcaaatccaaaccttggttggcggaaccctatttttaccgtgcggtggcgaagataaatttggacgattttaagggggccgaggaagactgtactttatgtcttcagcggaacccttttttaacacaagcgtattacgctcgcggcatcgcccgtcaaagtcaggagaaatacgacgaggcgatcgacgattaccagaaaggacttgagttcaaacccgaggaccggcagatgctggtgaatatggcggtggcttttatccagaaaaaagactacaacggggcggagaagacatttgatgatttaatgaccgcccatccgaaatattccatgaattatatgacacggggcgctatgtatctggagaaaggggatacgttgaaagccttggccgattataataaggcgatcgagatggatccttattatgcgccggcgtatggcaatcgtgcgatccttcattatcaaatggatgattacaaggacgctttggccgatttgaacgaggctctacgtctggatacccgtgagagcggatattatattaaccgggggctagttcgttatcagatgaatgacttgagaggtgcgatggccgattacgatcaggtgatcagcatggatagccggaacttgatcgcacggttcaaccgaggtttgcttcggttccaagtcggggataataaccgggctatcgaggactttgatgtcgttatccagcaagagccagataactatatggcttattacaaccgtgcgttgctccgtttcgagacgggcgactaccggggggccgtgcaggattacgacgtggtcttgaagcaatatcctactttcctgccgggctttgtgagccgttcggaagcaaagcgtaagctgggggataacgtgggggcagaccgtgattattgggcagccataaagatggaggagcaggccaagaacggacagctcccgaagacatcgtcttctggctccaatacggcggtgaacggagatgccaaggcggacgattcggaggagaatactcgtgagcaatccgataagaatatcaataagttcaaccgcttggtggtatacgataaggagcaggagcgtaaaagtaaataccaaagtgaggtccgtgggcgtgtacaagaccggaatgtccatgtggatctggaaccccagtttgtcttgacctattacgagaaggcggatcccgtaaagaaacttgtttattacgacaagatggtggaggattacaatggccagatggtcttgaagcgtaaattgcgtatcacgaacgaggaggccgctttgactgaggaccaaatcgccgtgcatttcgcctccatcgacgagtattcggcggagatcgagcgtgatccgaacaacgctaacgcttattttggccgtgcgatggacttcatgttggtgcaggatttctcggaggcgatcaagaatttctcggaagcgatcgagcgagacccgtcgttcacgatggcttatttcaatcgtgccgtggaacgttataagcaattgatgtacacccaatcccagcaggctagcaaggatacgtacgacttgagtggctcgggaatgaacttgaatattggtaagtccgcacagtcgcaggtaaacgccaacacctcggtggacctccggagcgctatgctgaaggataataagcgagcctatgagcatgagcagatcatgagggattacgatatggtgatcaagctgaacccgggttttgtgtacgcttactttaaccgtgcgaatctgcgttgcgcccagcgtgatttccgtgccgctatcgttgattataacgaggcgatcgagcgggaccctgaatttgccgaggcttactacaatcgtgggttagcccgtctgtcgcaaggtgacgtgaaccggggcatcgccgacttgagcaaggcaggggaattgggtatctacaacgcctatagtatcatcaagcgaatgacaagccggtgataacgcaaattattcgagttaaatgtttcgctgatagaaaagaaatattaactttgtgggctgaatataaagaattttagagaatagaatatgataaagattacatttccggacaattccgtaagagaatatgcaaagggaacgactgctatgcagatagcggaaagcattagttctcgtttggcacaggaagtcctagccgcaagcgtgaatggggaggtttgggacttaagccgtcctatcaacgacgacgctacggtgaaacttttgaagtgggaagacgaggaaggtaaacatgcgttctggcattccagcgctcaccttatggcagaggctttgcaggaattatatccgggtattaaattcggtatcggtccggcgatcgagaacggtttctattatgacgtggatccgggtgaggccgtgatcaaagagggtgatttcgctgctatcgaggctaagatgcttgagctggtagccaagaaagaagagatcaaacgtcaggacattaccaaggcggatgccatgaagatgttcggcgatagaggtgaagagtataaaacagagcttatcagtgagttggaagacggtacgatcactacctatacacagggttcttttacggacttgtgtagaggaccgcatttgccgaatacctcttatctgaaagctgtcaagatattgagcgtagccggcgcttattggcgtggcgatgagaaacgcaagcaattggttcgtttgtatggtatcactttcccgaaaaagaagatgttggatgagtatctgacattgttggaggaggccaagaaacgtgaccaccgtaagatcggtaaggagatggacttgttcatgttctccgatacggtaggtaagggcttaccgatgtggttgccaaaaggtaccgccttgcgtttgcgtctgcaagagttcttgcgtcgtatccaagctcgttataattatcaagaggtaatgtgtccgccgatcggtaataaattattgtatattacctccggccactacgctaaatacggaaaggattctttccaaccgatccatacacctgaggagggtgaggaatacttcttgaaaccgatgaactgtcctcatcactgtatgatctataaaaactctcctcgttcgtataaggacctgccgttgcgtctcgctgagttcggtacggtttgccggtatgagcagagtggagagttgcacggattgacccgtgtacgtagctttacgcaggatgatgctcatatcttctgccgccccgatcaggtaaagcaggaattcttgaacgtaatggacatcatctcgatcgtattcaagacgatgaatttcgagaacttcgaggctcagatctccttgcgtgacaaggtgaaccgtgagaaatatatcggtagcgacgagaattgggagaaggctgagcaagcgattgtagaggcttgtgaggaaaaaggcttgaaagctaagatcgaatatggagaggccgctttctacggtccgaaactcgacttcatggtgaaagacgctatcggccgccgttggcagttaggtacgattcaggtagactataacttaccggaacgtttccaattggaatatacgggtgccgacaaccagaagcaccgtccggttatgatccaccgtgcgccgttcggttccatggaacggttcgttgccgtattgatcgagcacaccgccggaaagttcccgttgtggttgactccggagcaggtatgtatcatgccgatcagcgagaagtttaatgattacgcttggcaaatcgcacgtgagttgggtaatcaggaaatccgtgctatcgtagatgaccgaaatgagaagatcggtcgtaaaattcgtgacaatgaattgaaaagaatcccttatatgctcatcgttggagaaaaagaagcagaaaatggtgaagtttctgtaagaaaacagggcgaaggtgataaaggttcgatgaaaattgctacctttgcagcgcttttgaatggcgaggtagaggaaatgatgaatcgctggcaaaaaagtaatgattaaataactaataacgaggagaataaatctttttgaatgaagaatgacaatctgaaagaacagtatagaatcaacgaacgtattcgtgttcgtgaagttcgtttagtaggtgacaatattgaaacgggtgtttatccgatcgctcaagcgctgaaaatagcggaagagcaggggatggatctagtcgagatttcaccaaatgctgcgccccccgtttgtagagtaatcgactaccagaaattcctctatcagcaaaaaaagcgtcagaaagagcaaaaagcgaaatctgtgaaagtggtcgtgaaggagattcgtttcgggcctcagacagatgatcatgattacaattttaaattgaagcacgctaagggatttttggaggaaggttcgaaggtcaaagcctacgtgttctttaaaggccgttctatccttttcaaggaacagggagaagtcctgctgcttcgttttgccaacgatttggaggattatggaaaagtagagcagttgccggtattggagggaaaacgtatgattatcatgcttactccgaagaaggcgggcactggctcagccccggctgcggccgcagctccgaaagttgtaaagaaagtgatcacgacacctaagcctaaaagcgagggtgataagaaaacagaagaataaaatccgtccctgatagaagggaggttaagtttaataattaaaaataattggaaaatgcctaagatgaagactaattccggtgccaaaaagaggttcgcccttaccggatcaggaaagatcaaaagaaaacacgcttttaagagtcatatcttaacaaagaagactaagaagcaaaagagaaatcttactcacacgggtttggtagctagtgttgacgtaagcaacgtaaagcagatgctttgcatgaagtaatctttattcattaagcgagttttataacgatttttattaaccgaatgcattagcaatcaagttcatcctaagagatgacgctaacattcaaaacagattagaattatgcctagatcagtaaatcatgttgcttcaagagcaaaaagaaaacggattttaaaactaacccgtggttattatggtgcacgtaagaacgtttggaccgtagcgaagaatacatgggaaaaaggtttgacttatgctttccgcgaccgtcgtaacaagaaacgtaatttccgtgctttgtggattcagcgtatcaacgctgccgctcgtatggaaggtttgtcttactctcgcctaatgggtgctttgcacgctgccggtatcgagatcaaccgtaaggttttggcagacttggccgttaaccatccggaagcattcaaggctatcgtagctaaagtgaaataagatttttgctatatagttaataaagagcctccccgaaaaggaggctctttttttgttgtttttgtttggttatgtcgatacgattacatatctttgtaacaagaaaaagataaacagggaatgagttaagccgcacttgttcgattgggaaactcatcagtttattttaattccgagacatagctcttgtcgccaatggcgggccgcgcccttcggggtatgcttagcacggcggattacaaaggtggcaaagcactcaaatcctgtcatacggagtttgttcacatctacagtgcggctttttcaaatagggaagaggatctttaattagattctcttcttttttatgcggttcacgcaggtagtctcgttagctcatataagtagtcttctgaggataaagtgaattattttgaaaataaattaggttttatagttggtaatccaaaaagaatgctttcctttgtaccaacaaacaaaagatagtttgtcttgctctttatcttcgagtttctattctcagtaatgataatatattcttctagaaatcgatcttcactaacatcacttgttttattattaatttatttttaatttttttcgtatgaatatttacattggaaacttgagttatcgagtaagagagtctgatttgcaacaagtattagaagagtatggtgttgttgattcagtaaagttaattgttgatcgtgatactagacgttctaagggttttgctttcgctgaaatgcctaacgtagacgaggctcaaaaagctatcgaggaattaaaccaagctgagtacgaaggtcgtcagatggttgtaaaagaagcaattcctagacgttaattttagaagatatacatcttaaaataactctgaagcggggagacgatagtctttccgcttttttgatattgtctattattgtcgtatatttacgcaccaagaataacacaactaaaaaataagtattatgacgttgccaaaacggtcttacatgaaagtaaccggacttgctctcgcttgttcctcgctacttttttcctgtgctcccaaggaggttccgcaggtgaatttaatccctaagccggcccatatcgaggtgactggcggttatttcaaagtagatagtaatctcgtattcgggaatgatcaatcgggtacgatccgttacgtggtcgatgagtctttcaatggcggaaatccggagggatatgcgttgaacgtgaccaagaaggggatcgagttgagagccgcctctaaatccggattgttttacggggaacaaacgttgcgccagctgtatacgtcgaaagggattccttgcgtatcgatccaagacaatccccgtttcccgtatcgtggcttgcatctggatgtctcccgtcatttcttcccgaaagaggaggtgatgaagttattgaacgtcatgtcttattataaattgaatacgcttcatatgcatttgacggatgccggtggttggcgtatccagatggataaatacccgaaactgactacggacgtggctttccgtacggaatccgattggcagaaatggtgggatggaaaggatcgcaagtatctgccggaaggaactccgggggcatatggcggttattttacgaaagaagatatccgtgagatcgtggattacgctacggcccggcatattaatataataccggaaatcgaattcccggggcattcggacgaggtgttcgtggcgtacccggagttgagttgtgccggcaaaccttatacgacgggtgatttctgcatcggcaacgagaaatcgtttacgttcatggaggatgtattgtccgaggtgatcgagttgttcccttccgaatatatccatatcgggggagacgaggccgggaagggagcttggaagacctgcccgaaatgtcaaggcttgatgcgccggaatgggatgaaggacgtggatgagttgcagagctatatgattcatcgtgccgagaaattcctgatttccaaaggccgcaaattgatcggttgggatgagattctggaagggggcttggctccggaggctaccgtcatgtcttggcggggcgaggaagggggaatcaagtccgcccgcatgggacacgacgtggtcatgacaccgggtggttatatgtatttcgatttctatcaagccgatccgaagacacagccgtatgccatcggcggttatacgccgatcaagcgggcgtacagttataatccagtgcctgtggattcgttgactgccgaggaaagtaagcatatcctaggggtacaggcgaatacatggacggagtatatcaaggatgagaaacatttggagtatatgatgttccctcgtgccttggcggtcgccgagatcggatggactccgcaagaggatcgtagttgggaggattttaagcctcgtatgaacgcgaatatcccggttctgcaacggatgggtatcaatacgttcacgctctcggacgagatcgagaccacgatggaggtagataccttgcggcgagagatcaaggtcatgttggatgcggagaaatatccggcggagatacgttacacgacagacggctctattcccgccgcctcttcccgggtctataacggcccgatcgtggtgaaagactccgctgatatcaaggccgctatcttccgtgacgggcagcttcaaggaacgcctaccgagaagaaggtggattatcaccggggtatcaataagcctatacattataatagtaagctgtatagcggttatatggcgggtggcatgaacgccttgctggacggctacaggggaggcttgacttatctggacggtcgttggcagggttatttgaatgacttggattgcgtggtggacatgggcgaggtgacggatatccataaggtatcgtcccgctttatgcaattgatcggcccgggcgtgtaccaaccgggagaggtggagttgctgacatcggaagacggggagagctatatctcgcagggagttatccctactacgatatccaatacggataaagacctgtcttttcaggaatatacgtttaacggcgattggaaagcccgttatatccgtatcaaggcaaaagaggcaaataagggtttcatcttcacggatgagatcgtgatctggtaagtatgaatcaattaattatcaactaaaatacatttatcaaatgaagaaacagttaatgaccttcctgttgtgtggcagtctgttcgctacggcgcagcaaccggtagattatgtgaaccccttcatcggtacgagcaattacggtacgacgaatcccggtgcggtttgtccgcagggtatgatgagcgtggttcctttcaacgtcatggggtcggagaagaaccgttttgacaaggatagtcaatggtggtctactccttactcggcagacaataaattctttacgggattcgctcacggcagcttgagcggcgtgggatgcccggagctgggaggtttgctattgatgccgacgacgggcgagttgaacgtggactataaggcttacggcagtgagtacaaggacgaggtggctcaccccggttattatagcaataccttgaccaagtataatatcaaggcggaggctactgccagcatgcgtacgggcttgagccgttttaccttcccgaaaggggagagccatatcctcttgaacctaggcgagggcttgacgaacgagaccggcgctacggtacgtatcgtgaatgatacggagatcgagggtagcaagttgatgggtaccttctgttataatccacaggccgtattcccggtttacttcgtgatgaaggtaaacaaggccccgaagaagatgggttattggaagaaacaacgtgagatgaagggggtagaggccgaatgggatatctactccggcaagtataagttatataccagttatacccgtgagatgagcggagacgacatcggcgtatggttcgattatgatacggacgagggtgaggctatcgaggtgaagatgggtatctcgtacgtgagcatcgagaacgcccgcctgaacatgaatacggagcagcccggcttcgatttcgacaaggtccgtacggcggctagcacgatgtggaacaaggatctttccaaggtacaagtggaaggaggtacgaaagacgagaaaacgatattctataccggtatgtatcatttgctgatccatccgaatatcctgcaagacgtgaacggcgagtacccgatgatggagagcctgaaagtaggccataccaccggaaaccgttatacggtcttctccctgtgggatacgtaccgcaacgtaagtaccctgatgaccttgctctatccggagcgtcaattagatattatccgtacgatgctggatatgtaccgggaaaacggttggttaccgaaatgggagctttacggacgtgagacctttacgatggagggcgatccctcgatcccgtatatcgtagacgcatggatgcgcggcttgcgtgactttgatgagcaaaccgcttatgaggcgatgcgtaaaggcgctactaccccgggagagttcaacctgcttcgtccggacgcgaacgattatttcagcaagggctatgttcctttgcgtgagcaatacgataactccgtatctcatgcgctggaatattatatcgccgactggaacttggctaatttcgctcaagccttgggtaagaaagaggatgccaagttattccgtgaccgttctttaggttacaaacattattatagcaaggagttcggaacgctgcgtcctatcttgccggacggcactttctactctccgttcgatccgaaacaaggcgagaacttcgagcctagtcccggtttccatgaaggcaacgcatggaattatacgttttatgttcctcacgatatcaagggactggccaaattgatgggaggcgataagaaatttgtcgatcatttgcagaaggtattcgatgacggcaattatgatcccgctaacgagccggatatcgcttatccttatttgtttagttatttcaagggagaggcttggcgtactcagaagttggtccgtcagttgttgaaggattgctatcataacgccccgaacggtgtcccgggtaacgaggatacaggcacgatgtccgcttgggctattttctccatgatgggcttctatccggcttgtccgggcgacgtgaactatgtattgacttccccgactttcgataaggttacgatccagctcgacaagaaattctatcctaaaggcgaattggtaatcgagtctaagcatagtaatccggaagcgatctatatcaaggacgttttcgccggcgataaaaagctaaagggctacaccatctcgcaagaggacttggtaaatgccggaaccttgcgttatatcctcgaggatacgcataagtaagccaagataaagatataccgaatttgatatttaccggacgcagatgacaccgacaagcacgggtgatctgcgtccggtttattttttgatatcctaaaaccatttgatcttcctgaatataaaaaaggccgtagcggatagcaagatcgagagcaagatgataaccacgaaaccatgcggcatatcctccatgtagatcgggacgttcatcccgtagaagctagcgattaatgtcggaaccattaagataatggaaagtgatgtcatacgtttcatgatcgtgttcacgttgttggagatgatagaggcgaaagcgtccatcgtacccgtaagaatatcgctatagatatttaccgtgttatgggcctgtttcaactcgatctccacgtcctccactaaatccttgtcgatatattccggctcttggaaaatattctggagcttggccagcatcacctcattcccgcggatggaggtgttgaagaataccatgctcttctccagcttcatcaacgctagcagatcctcgttgcggatgcttttctccaacgccttttccgcctcggtgacggcgtaattgatttgtttcaggtatttaaggaaccatacggccgatgagtggatcagccggaggatcaactcatacttgtttttaatctggagttccttccgttgggtataacggatgaaatcggggatcaagtccgtcttatggtaacatacgcttacgatgatctcattgttcgtgatgataccgatcggcaccgtattgaacgggatgtcatgatcttggttctgcaacgggatacgtaagatggtaagcaaccaattcccctcgtactcgatacggggacgttcgtccgtatcggctatatcgctcaagaatgattcgggtacgttaaatcgatccatcaagaattgaagatcttcgggagtcgggcactctacgtttacccaactgttaggaagccattggttcttctccacataaccggcctcacaataaagaaattgtctcattattgcctcctttcgtgtttaatccgagcagaggatcaatgaaaccctccgcctcgttagttcatactctgttctgtttctagcgggatactgtcgtccataatttgaaaattactttttacgggtgcaaagataatacttttttacgtaagtaaagttatgtcgctgtatgctgacagcaatattgttgccagtttacgttagcataggcttacttctctgagagtattgcgatacttctggtaatagtactggagtactttcatggaagtacccgagtactgcctaagaagtactccaatacttcttaggcagtactggccatctattcaatcccgcatttcccctcttcgttgaagtagaagaagagcccggtatctatgctggccggaccatggatacggcttacggcgggttcccatgcgggcatcaaccggagtacccgtaaggcttcatcgcggaactcaccgtaggttttccccgtatcgcgaggatacagtatattctcgggtaggcttacgggattctgtaacatacctaaggaatcgatcgtgaaggagtagaagagtcgtaccttcgtgcccgtacctttataagattcgggataacgcaggttctgttcgaagaaacgggtcatggcttctcttcctcccttgaactcggccatggggcgaggctcgtggagccggctggcgaagcgtgtgtattcctcataatcttccgggttatcggataggtagaacgtggcggccaaaggataatggacgatgccggcgccctgtccggtgatgacggtcttatgcacccggtacaatcccggtggattttccttgagctcaggcagtaaggtggccgagaaatcgtctcttgtctcgtttggaaagatcggatagccgatatcaacaaaaaagttgggttgcgggacccctttccatgccttcccgtcgaaatgctcgatgaaataactttcgcctcccatcccttctaggtcggtatggttggtgatggcgatctcgatccgttcgatgttggttgggtagacattcgggcttactcgcatggagaagtgggtggtgtcctcgcaaagagattcctcgggcgaccggtcgtaagggcctccgccgatccggatgaggggcgagtcgaatacatacgtcttaaatgcttttacatacggagcttccactatgataagctgtaggaagacggagtcgtccgtgttccagagggaggccatgtttctgcggatcttccgtagatgcgggggaagggtatcgtattccttgccgaagaacaattctatgctgtcccgtatctgcttggcggtccatccttccgtggaaactgaagatgcggcatgggtatcagtcggtaacggtagggtatcttgccgtgctatggattgggagtcggctgagtagtcgctactgttttcccctttcttttgtttggtatggcagccgtataataggcagccgcccatgataactaatccgataaaatacgctttcatgattcgacaggttttaattcctaaatataaagaatctttttcagaaatgggtaaaagatattacctttgactccccaaatagaaagaatgatggcagaaggaacaagaaatacaggaagaggaaggaaaaagcctgtggagatgctccccgatatggggcgtcttcagccacaggcccgtgagttggaggaggctgtgttgggtgcgttgatgctggagaaagacgcgtactcgatcgtcagcgagatcttgaagccggagtgtttctatgagaaagcgcatgagaagatttatgccgctatcgtagacttggcgttgagccagcgtcccgtggatatgcttaccgtaacggagcaattgaagaaacggggagaattggaggatgtaggcggaccgttctatatctctcaacttaccagcaaggtggccagtagcgcccatatcgagtatcacgcccggatcattgcccagaaatatctggcgagggagttgatctctttcacggcgatgatccaaggaaaggcatttgatgagacgctcgatgtagaggacttgatgcaagaggcggagggtaagttgttcgagatctctcaacgtaacgtaaagaaggatgtcacccagatcaaccccgtcatcaaggacgctatggagatgttgcaaaaggcggccctccagaaggaaggtctgagcggattgcgcacgggcttcgagggcttggataagatgacttccggttggcagaattccgaccttatcattatcgccgcccgtccggccatgggtaagacggctttcgtcctttccatggcgaagaatatggcggtgaatttcaatacgcctgtcgccctgttctcgctcgagatgagtaacgtacagttggtaaaccgtctgatcgtgaatgtctgcgagataccgggtgagaagatcaagagcggacgcttggagagctacgagtgggaacagctggactttaagatcaaggagctttacgacgccccgatcttcgtggacgataccccgagcttgtccgtcttcgagctgcgaacgaaagcccgtcgtctggtgcgtgagcatggcattaaatgtatcattatcgactaccttcagttgatgaacgctagcggtatgaacttcggtagccgtgagcaggaggtgagtacgatctcccgctcgttgaagggattggcgaaggaattgaatatcccgattatcgccttgtcgcagttgaaccgtggtgtggaagctcgtcaaggcgtggaaggtaagcgtccgcagctagccgacttgcgtgagtccggagctatcgagcaggatgccgatatggtatgtttcatccaccgtcccgaatattataagattacggaagacgagcggggaaattccctgatcggcctcgccgagatcattatcgccaagcatcgtaacggtgccgtgggggatgtccggctgcgctttaagagcgagttcgccaagtttatgaacgtagaggaagatatagcggtaagggaattctcctcgaccatgaacggtggagacccgatgcccccgatcccatcggcgggagctgacttcttgagtcaaggtagcagtaacgaggttccgttctaatatagcatgaatgagcgaaagaggcgaaaacgtttgcggtagatttttcgcctcttcttttctgtttcgttggcgaatccggttcgaatcttctatctttgtgattgaaaacaaattactgaatcagccatgacgagacacttagttccggtatctatatacctgtcgctgttgcttagctgcaactcgccgaaagaatacaaatcctttgatgaatacccttcctatgagggagacgatctggagttgttctattctcccacgaaatccgtgttcaccctttgggccccgacagcggaagaagtccgcttgaatctttacgcctccggtgaaggaggggagcctgtccgtcggttgccgatgaaatcctcggataagggtacgtggcgtatctccgtgagcgaggatctgaaaggctccttctataccttccagatccgtatcggcgataaatggctggatgagactcccggtatctgggcgaaagccgtcggggtgaatggaaaccgtgcggccgtgatcgattgggcggctaccgatccggagggctgggaggcggataaatctcccgagttgaaaagcttctccgatattatcatctacgagatgcatcatcgggatttctcgatcgccgcgaactccggcgtgacgcataaaggtaagtttctcgccttggcggaggagggcacgaaagggccgggcggcgtggctaccggcgtggatcatctgaaggagttgggcgttacccatgtccatatccttccttcttatgattatggctcggtggacgagactcgcttgcaagataatgtgtacaattgggggtatgatcccaagaactataacgcccccgaggggagctattccaccgatccttacaatcccgaggctcgtatccgtgagttcaaggagatggtgcgggggttgcaccggaatggtatccgtgtgatcatggacgtggtttacaatcataccttcgtgggggatgggtcgaatttcagtttgaccgttcccggttacttctaccgtcataaaccggacggaagctattcggatgcctccggctgtggtaatgagaccgcttcggagcgggcgatggtacgccgctatatcgtggagtccgtgaaatattgggccgaggaataccatgtggatggtttccgtttcgacttgatgggcatccatgacgtagagaccatgaacgaggtaaaagccgagttagctaaactagatccttccatcttcgtatacggcgagggctggaccgccagcgattccccgctaccggaggatcagagggcgatcaaggtaaacgccccgaaactgaatgatgtggccgtatttagcgatgacctgcgggatgctttaaaaggaagcgtattcgagactacacaggccggtttcgcctccggaaagccggaaggtaacgaggagtctattaagttcggtattgtaggcgctatccgccatccgcaaatcgactataaccaaatattatattgcaaagcgccttatgcgaacaagcctacgcaagtgatcaactatgtctcttgccacgatgatctttgtttgatggataagttgaagctctcggccccgaaagacgctaccccggatgagttgatacgattcggcaagttggcccagaccatcatcttcacctcgcaaggagtacccttcatgcgggcaggagaggagttgctgcacgataagaagggcgtacataacagctatcaatcgcccgattcaatcaatgagatcgactggtctttgaaggcaaaaaacaaggatgttttcaactattacaaggatttgatcgcccttcgtaagtcgcacccggctttccgtatcgccacggccgagggagtgagggaggcccttcaattccaagaagtgaaccagcccggtgtcgtagcgtataccttaggggaacatgcgaacggggatagttggaagaagattatggttatctttaacgggaaccggaaggcggtaacggtttctctgccggaaggaacatgggttccggtttgtaaagacggtcggatttatctggacggtaaaggttccgtacagggtaaaactaccgtaagcgcctcttccgccttgatcttgaaacaagattaatacggaactaaatcaaagaaaatcccccgggacatctcgatgaataccgagcgtcccgggggattttttattaaatcacttacttatctgattatttgtaagcctcgccttttacagctgcgatacccggaagaaccttaccttctatagcctcaagaagagcgccaccacctgtagaaacgtaagatacgccgttagccaaaccgaatttgttaacgcaagcaacagagtcgccaccacctactaaagagaatgcgccgttcttcgtagcctcaacgatagcctcgccaaccgtgcgagatccgtgcgtaaagttctcgaactcgaatacacccgtaggaccgttccaaaggatcgtcttagagttcttgataacgtcagcgtagatagcctcggtcttcggacctatgtcaagaccttcccaaccatcaggaatctgatctaccggagcgaaatcagtcttagcgtcgttgctgaaatcgtcagcgatcttagcgtcaacagccaataccaagtttacgcctttttctttcgctttcttgatcaaatcaagagcaagatccagcttatcgtcctcgcagatagacttaccgatcttaccgccttgcgctttcgtgaaagtataagtcataccacccgtgatgatcaagttgtctaccttgttcaacaagttctcgatgatctcgatcttggaggaaaccttagaaccacccatgatagcggtgaacggacgttggatgtcgttcataaccttatcgacagccttcacttctttctccatcaaataaccgaacatcttgttgtccgtatcgaagtagtcagcgatcaaagccgtagaagcgtgagcacggtgagcggtaccgaacgcgtcgtttacatagcagtcagcgtaagaggccaatctcttcgtgaactctttctggctttctttaacggctttcttggcagccttcttctcctcgtcggaagcgtcttcagccaaacctcttggtttgccttcttcctcagcgtagaaacgaaggttctcaagcaacaaagcttcgcccggttgcaaagcggcagccttagcgccggcttcttcgccaatacagtcgtttgcaaactgaacatctacgcctaacaactcagaaaggtgcttcaatatgtgctttaaggagaacttatcagtagcgcctttcggacgacctaggtgagaaccgataattacgctaccaccatccgctaagatcttctttaatgtaggaagagcggcacgcatacgagtgtcgtcggtgatgttgaagttttcgtccaatggaacgttaaagtcaactcttacaaatgcctttttgccggcaaaattgaaattgtcaattgtttgcataactattgtatttaatgtctgtattaaaatgttcctttaatcgcttgcaaacttacataaaatatttttatttgaccgtttgcgcttgctttaaattttataccaatttgaaacgtagccgtaatctcccgtcagcatagtcgtaattcaacagcttgaaatgtccgatctcggatgtattcgccacgtgcgatccgatacatgcgcaggcatcgtaatcgcctatgcgtacgatacgtaatgtgtcgctggcatcatcgggcaatttacttaaatccacgataccgccggccttttcttttggcatgaactcgatggttacgggcaggtgccggtcgatcacctcgtttatcttcttctcaacctcggccatgacctccgcactgggctcttccgccaatagataatcgcatttagacttcttcctctctatgtgtgcgttcttggatctgggacatccgaacatccgtaccattgtctggtttaagatatgttccgccgtgtgcataggaggatactcttgcttgttgtgttcgttcagttggatttcttgtttcatatatttgatgttttgattgtatttcgtgaaaaatatgctcaaatgtacgaaataaatctttagttttgtaaagtcatagaaaacaccttaaaggaacgatatgccagctaagcgcttatttggaataatatccatcatatttctctttgttacctgtatatcatgtaaatcctctacagacttatcggaggagaagcgtatactcgtgattcaatcttacgaaaaacattttcccgcctatgagaagatgaaggaaatcatgtcgagtgatttgcggaagaaggggatacatgcgagtgtctattctttttatttggattgtgagcaatattcggagaagcaacagcgacagaaattattcaagaaactgaatgagttatcgacatggaacccggatattattctggtcaatgacgatcaagccttgaacgctttgataagtagtaggcatcccctcgctaaatcgatcccggtcgtgtttatgggggttagttatcccaatatcccgatcatccggaaatatccgaatatgatgggcttttatgataaaccggattataagaggaatatagaattgatacggcggcttgttggtaattgcatcgtcataagagtctcggacgatacctttcaggataatatgatgctggcggacatgaatgcgcagattcaggatatttgtgccgtgaacaatatatattccttggatcgggtacgtttatccggaaagaacgggatttcgatatcggatatacctaagataaagccggatacgatgtatataagcacactcagtacgaaatcggcgaatgccctgattaagggattcggcgagaattattataataaagcgtatctggcaaccaagagggattatatgacaatctcgttggggcggctcagcgcctttccatgtttctccgtgatcaatgagttgatcggtaatcagaatggcgtagttggcgggtatgtaactgtctttaaggatgaggtagaggcagctgtaaaccgggtcgtctctatcttgaaaggaacgcctccatccgatttcccgcaaatcgaagagagtaacaaggcttatgtttttgattacggtgtgttagaacgttggggcattgatagtagtaaattgccggaaggagctattatcgcgaatatgccgtttgtcgttcaatataaatattatatatgggctgccggctttattctggtggtgatgttgcttctgctttttagttaccaaagaaagcgatatatacaggaggctttacataagaaggatgcgcaggagaagttaaaaagggagaagacttttctttcttttgcgttggatagcggcaacattttcgcttttcggtatagcaaaggggtattcgagtttgataatagattctaccattatttaggtatgccctgtgtaccgatgaaaatcgaggagtttcaggatgctatacatcctgaagaactggataatttccttcgagaccggaatctgctggatagtggctttctttcccggaaagtgacgcaacgtcgttgtaactttaataagaaggggtatgagtggtgggaatttcgctatgcccaaaataagaatgagaaagattcggtttccggtgacgaagctgttgaggtaagtggcttatgcttgaatatccagcggataaaagacacggagaatagccttatagccgcccgccggaaagcggaggaatctgatcggatgaaattagtctttttggcgaatatgagccatgagatacgtacgcctctgaatgcgatcgtaggcttctcccaattgctcaattcggatatgcctttggaaccggaggaaaaggcggagtttatagatctgattaccaaaaacagtgacctgttgcttaagctgatcaacgatatcttggatctatcacgcatagaatccggtagcatgtctttctcttatgagaacctcgatctgagtaaactgatgggagatatcttccatacgcatcaattgatgatgccggagggagtggagttaaagataagggttccccatgaacctcttatcatccgttcggatcatttccggttgacgcaggtttgtaccaatttcattaataatgcggtgaagtttaccgctaagggatatatcgagatcggatatgaacttagcgcagatggaaaatcgatccttatttccgtgaaagatacgggtaagggcattcctgatgataaaaaggaaaaggtattcgagcgtttccagaaactggatgagtttgcccaaggtacaggcttggggttagcgatctgccagagtatcgttcatacgtttcatggaagcatatcgttggaatccgaggttggcgtaggtagtaagtttacgatctcgctaccttataccccgggattggagctggaggaaagaacttaattaccttcgatgaatcgtttattggccctcgcttcttcctgccattgggggatgacggtttctaaaaacttttgtttggcctgttgctcggcttccatatcgaggccgatatattgctgggctttcgctttcgtggagatatccggcatcggaacatcttgggtatagcctagctgcgctaagaccttcatgatctggatgcgggcttgggtagccttatcgagtccgctgcccaagatacgtgtgacttcttggggcgcgtggaaagccgccccatgtgaggccacggcgaagtcccaacgccattgtgcctgccggagcagttttaatacgtttttcatttgagattccgtagcgcctttgtcccaagcgaatttcgcttctatatgggcttttgtcaattcttcctctacacgcatgcgtatggcgtagactttgttttgccgttcataaacatccttgcgtaaggtctcctcactttcccggtggcaggcttggcaagtacggtctatcattgccaacgggcttttgatatgatggttgttgtaccggttctcatcttccccgacagcaggcatatggcattctccgcaggaaacgcctctttgcccgtgaatgcccatctggaataactcgaaatccggatgttgcgcctttatcaaatgtgcccggcttaatttatgggtgaaatcggtgaagtttatgctatcgtaataggcttctatattttctaccgtataaccttgatcccaaggtaaggttagtatacgatcttctccttggaaataatattcggcgtggcattgggcgcatactaaagatcgcatctcttgctcggttgcgtcctctatacgtaatccgttgcgcttataggcacttttcaagaatgagcgggtcacgcgcaatcccatgctttgcggttcatggcagtctgcgcatccgattggatttacgatctcgttgcctagctccgcccatttcttcttatataaggtcttggcatcggtggtcgttaataagcggggtatgtccggacttttacatgcccagcatgcggcaggctgggggccactcgtcggggtcataggagcgccggtccgcaggcttttgtatagatcttctatggaatacatatgccctctgggacttagataatctttggagaaagcgtatcctgcccataataccaccattccgggatgttcggccaagatatcagcttgttggttcccattaaacaaactgcggaaagtcgtgtccgaggtttgtttccaactttggtactcattggaataacgaaggtctatagagtcgctgttttgttgatctattggctgatcatcggtatcgtcgatgaatttgatgctatcttgtccggtaacagtggtacgtaagatcactaatacgataatgacgattagacttatggctatagaagttttatagtgtgctttcaagtgtttaccttttatcttaaataaaatattctttgtattaactgcgaatatatgaataataatgatacgaccggtagaaattgaaaaaatccttatttcattgcttccgaagacgctggatgaaataaggattctcaagtgactcgcataggattcaaacctataaccttctgatccgtagtcagatgctctattcagttgagctagcgagccaatctataaatgaatttgaatattcaagtgactcctaaaggattcaaacctttaaccttctgatccgtagtcagatgctctattcagttgagctaaggagccaagatatattctattgctatcttcgaatggtgaccgcgacaggattcaaacctgtaaccggctgatccgtagtcagctactctattcagttgagctacgcggccattgtttcgtgattgcgagtgcaaaggtacgtttttgttttaaatatgcaaacgtttcgactacttttttgcgaatttaatctaacatttttggattgaagatcagataaccaatgtttaagccaaagttgaaattctccttcggataactgtatccgttggcgtacagactgatacataagaatggcaattgcaatacgaccgccgcttcacccatataattaaacgagtgcaaaaacttaccataatgcgggattccgacatacgggttgttttccggcaccgtcttttgtatttcatagagcggagcgaagccatacatatccaaccggaagtgcagaagcttgcttaacttcaagatcggggaaagcccgaaagccacatattggttcgcccggaacgcctcgttgaatacaatctcgctatggggtgtcggggtaaacgccggggcctgtaatacgctagccgtatagttattcatgaggttcttgctggatatgaccatttccgccaaataacctaagttgaaacggttgctcagcgtctggtattggttccagcgccctttcagttgcagccagctatgcactttgcgaccaatcggggcttccgtcgtggcggaagtgggggatggggtatacttctccgtaccggttacgtattgggcgattaggaattgctgttttccgcttatcgggtattgtttggtgttgagtgagttttgctcgatacttaacgagccgctgaataaatcgtaccagctatggtcgaaagaggcgttcgggaaaggtatcgtggtgctctgcaaatagaaatcgttcaaccgtccgtaggcgaacccgatctccgctttcgcgtggttgaggaaggggaagcctaattttagtttcatgtacagttctttctgcttaatcatggcgggcactatatcctcataaaagagggattggctttccgtgtatttcttgtccgagaagactccttgccaatttaaataagtggggatttgcgtttgcaggtacatccggccactcaacatgacaccactaaaggagttacccacttgaaagttcgagtttacgtcggcggcgaaccgtcccagatattgataccccaatcctaggtataattgattcgcttgatgagacgatacgtttccaccgaagccaaccgtgatctcttctttcatcttcacgtccagataaagatcgaatttcttctctttccggttataaacggcatgcggcatgatttccctaatcttggaataggtcagcatcttgaaataagcccgcttgaactcttccatggagaactcgttattgatatccctgtgtaattgggcctctatgtatttacgctgggcctcggatacgcccgtcacgtaaatattgcggaagatcagcgggggaaggttctctttataggcttttcttctttcggtaacctcatttaaaggcacttcccggggaacccgttgcttgatggagtcgatcatggaaagggtacgtttatacccgatgtccataagctccttacctttctggaaatccaataaggagacggtggggaaactgaatttaatcatcatgccatcttcttccggtacctcatagtcggtcttttgcatgatcatggtctcgatctggttataaggattctccgaaggctttttattccctcccgataccgttgatccgaaaatgaaatccgggtggaacgcgtctttcatcgggcctaccgggaaattatcgtagatacctccatcgaatagaggaatactgtctttccatatgggctggaagaaaaaggggaaagtcatggaggcacgtacggcgtctcccagatccccattcttgaagatgatcggctttttggtatatatgtccgaggccacgcaacggaaagggacaaacaggttgtcgaaattccaccccgcctttgccgtcgcctgcgagaacagggccatgaacgcctgattcatctgtatgggattgatcaagctttgcggtaagaagctagccttgatctgtagggaatcggacatatcgatggagaaatgcgcgaattccggggtcgggtaaggctccttgaaataataggtatattgctcctccaccgtacctgtttgccaataggagaactccttggaaagcattagctccagcatctcctcgggggaataccccatggcgtataaactaccgataatcgccccgatggaggtaccggtaatgtaatcgatcggtatattattttcttccaacgccttgatcactccgatatgtgccgctcctttggcaccgccgccactgagtaccaaccctactttctgggcggaaacaatctgaatggcagcaaggaataaggctatgataactgttattttcctcatatgaacccaatctgtttttcttctccaaatgtaagaagtatttctttagaaacataaacattttgttttttcgtattgttgagttatcaatacaattaaaacagaagatgttatgaaagagaaagaattgaatagggaagagcggaataagaccgttatggagactggtgctttggtcatggctgagttttatgcggattggtgccctcattgccagaaaatgatgccgatcgtgaaggagttcaaggaattggagaaaggaaaattagaagtggtacaaatcaatatcgaggaggagagcgctcttgccgatttgtatacggtggaatcgattcctacttttatcctgctacggaaaggggaggctttgtggagacaatccggcgagatgaacttggataggttgcggaaagtggtcgaggatgtcgtgggctgaaactaaaaaaaccgttcccccgagaaggaacggttttttatatatgtgaggattggtttatccgatcagttctacgctacgtttgatgaattggcttaaggcctctcccttcagcataccgtttcctaacaaagcaaggtcgatcaactgactaactgtcttgttcgtaccggcgtactcggccagaacttggttgcgttgctcacgaagctcatccagcttatggtcggtgttggtcatatcctctttctcttgcgccgtgatctcatcttctttctttttgctttgagcctcacgtaagtcggcttgacgagcctcccatcctttgatatcgctaaggatcggttttaacttctcgtcgcaagcttgctcctcttcagttaatactttcttgatcaacggatgatccgtattcaatacgaagttgaagctatccggcatctcgccatagaaagacatacccggttgcatagcggacatctcacgcattcttcgcatatactcgctttgtgtcaacatgacagggttcgcgttttcgcccaatgcctcgaatgttacgtagaactcggtcttgttcaatttcggcatctgactcttgaatacttcctgcatggccattttctgctcctcgctcaaggttaccttattcgagtcttccttgcggatcaggttatcgatcgtatcgctatccacacgaacgaagcggctcttctcgaacttctgctccaattgtccgatcaagtgtacatccaattgtccgtccatttccaagacgctgtaacctttgtcctttgcggcttgtatatagctgtattgctcgtctttattggtggtatacagatagattaagttaccctctttgtctgtctggttgtccttgatcaagttcttgtattcctcgaaagtgaagtatttgccttcgacgtccttgaataaggcgaacttaaccgcgcggtcgtagaacttctcatcagtcaacataccatattggatgaatagtttcaagctatcccatttctcctcgaactgcgggcggtcgttcttgaagatctcttccaagcggtctgccaccttcttcgtgatgtggttggagatcttcttcacgttctgatcgctttgcaaataggaacgggatacgttcaacgggatatccggcgaatccaatacaccatgcaataatgtcaagaactcaggaacgataccctctacggaatccgtaacgaatacttggttgcaatataactggatcttgttacgatgcaagtcgatattgctcttgatgcgagggaaatataagataccggtcaagttgaacggatagtctacgttcaagtgaatccagaacaacggctcatccgtcataggatataagtcacgatagaacttcttgtaatcctcgtcggtcatatcggccggtttgcgaacccatgccggtttggtgtcgttgattacgttatcttcgtccgtatctacatatttgccatccttccactcttgcttcttgccgaacgcgataggaaccggtaagaaacggcagtattttgtcaataagccattgatcttatccttgttcaagaaatctttattctcgtcgtctatatacaggataatatcggtaccacgatcctctttcgtcgtttcctccaaggagtattccggtgtaccgtcgcagctccatttcatgggaacagcgccttctttgtacgatttcgtcacgatctctactttcttggaaaccatgaaagaggagtagaaaccaagaccgaagtgaccgatgatagaagcggcgtcgttcttgtatttctcaacgaactcctcggcgccggagaaagcgatctggttgatgtacttatcgatctcctcggccgtcataccgataccccggtcagagatcgtgatcgttttgtcatcgaacttaacctgtacggtcaaatcgccgagttcgcctttaaactcgcctacggaagaaagcgtttttaacttctgggtagcatctaccgcattagaaacaagttcacgaaggaagatttcgtgatcactgtataagaacttcttgataatcggaaagatgttttccgatgttactccgatgttaccttgtttactgctcatagtctgaatatcttattatttttattgttattttgtgcgtattcctgatcctgatcattctcaagatccgcctattcctatacaaaacgaatgccaaaatgtttcggataaactataaatgacaaaaaggcagatgccggctgatagatttgcagccgggcatagtttgatcaaaccatatcatctcctgtcttggcgaatgtaacacggatggttttatggaatgggataaaacgggatacgatcgctatgaataaggagatggctaataaataccccagtacctcttttaacgccaataataagctttgttgctgtaacgtattatagagtgtattggtagccatttgcgctgcctcgtcgtagggatgcccttgggtcaaggcgttgccaagcgcctgattataacgtgaggcggctagaggatcggccagcgtaacggtttctgataaggaatacatatatttttgttccaagcgatatagtatattactgtaaaaagaagtcgccatgataggggatagtaccgaacggaaaatgatgagaaagaaagcgtttgacaataaatatttaggatttaaatcttccacggcaaataaggcaaaagctatgataagaatcatcatgcccaatcccctgaggaatataggaaagtagagcatctcgtatctgctatccggtgagatcccgaaataaaggctcccgaagaacaggacgaaacaactcattcctcccgctatcaagaaacgaaaccgccaacgttgccaccggaaccaccaaaaacagatgaacgcccccaagacatatcccggaagcaaataagtataaagggaataggtatgggtactgtctacctttaagatactggtcaggtagctggtcaacaaggtagtcgaagtactgaaaaacatgacaagcatcatatagaaataaccgataatggctttcggctggtataaaggcgccagattcacgtacggacgttccgaatgatattgataccaaataaataaagcgatcaatatcggggcgatcatgatataaaggcaaatcttgggggatgccatccagtcgagtactttcccgtaattaatgacatacataagcattaacaatccggtggatatgatgaacatttcccggatgtgtagatcggccaaggggatggacttgatcggccggttatggcggaagcagatgattaccactactatggccaataaaatcattagcatcatgaagtaatacatatatttccagtcgtaatggtaggctaactgtgcggtaacaagcatggacgcttgtccccctccgaaaacaaaaggatagaagtaggagtagaattggctacgtatatttttagggctgaatatcttttgtgcgtaccggataaaccacagcatgagaaaccctttcaggaaaccgatcgcgaaactacagacgatcaatatgtcggcgttctgggagcgggcacagatccagcttaagaagaactgggcgactaaattcgctaacaataagaattttatagagaaggcttctaatatcttcggaataatcggataggataccgccattcccgccgctgccgcgtaatatcccatggttatatcctcggtgttcgtgcctagcgtgtttgatacctccagcatactgcctgtgtacgaaccgtttagcatcgtaaccggaaggataacgatgaagatgcaaatcaatcctaaccagtccggcacccattggcggatcggtgccccaagctctttcatcgtgatcatttgcgtaaggcttctgtttcaaccatcatgcctgctcttaagtattgcgtatcttcttgcgatagattttccaagtctatccgtaccgggatacgttgttgtaccttgacgaagtttccggcggaattgtcggtcgggaccaatgagtatttggagcctgtggcgtcggagattgcagttacctccccgttgaatatctttcccggcaacgcgtctaccttgatacgtactttttgcccgatatagatgtgggggatctgggtctccttgtaattggccgtgatccatttgtctttatctcgtacgaggtaggatatcgtttgtccggcttgcacgtattgtccgggctctaaggtccgtctgcctacatgaccgtcgtaaggggcggttataacggtataggaaaggtttaacctcgctaaatccagatccgcttcttttcgtaagatcgccgcctcggctcctgttgtcttcttgctggtttcggtgaattgggagaaagcggctttcttttgttccaccaacgcctgatatcgggcttgcgccgcctcgaaagcggctttggattgctcgtattgttgctcggggaccgattcttctttcagcagccgctcaaatcggtgataatcctgttccaattgccaaagcttggctttagcctcggcgatgttggcgtcttgtacggcgatgttcgtatgggaggtctcgataccggaacgaagtacgtcttgtgatccttgggcgtcgatcaacgcggcctctgcctcttttaccttgatccgatattcccgatcgtccagtatgagaagtgtgtccccttggtgaacgtactggtgttccttgaaacggacctcttttatgtagccggaggcacgtatatttagtggggcgatatattggtccacaaaggcatcgtttgtcacctcataattgatgtaacgccagaaataattggctgtccaccaaatgccggaaccggctaaaaggatacatatggagtttaatactatattccgtgtccttactttctttagtctttgatgtttctcttttaattcgtttgccatagtcgttgtttctttttagagacggccgcaagccttctgtagttgatagtaagtgtaaatcacgtgggtacgggcattcgtgagctgtagctccgcgttgaggagaaccgagttcgcgtcgagtaagtcggttaggatcgccaattggtttaaataccggttttgcatgatcctatagttctcttgagcttgccgtacggataacttcaaggcttccacttcttgtagggcctccttatgacgtaagaacgcggtgcgcacttctatacggattttctgctttttctgttcctcctcgtttttatataacgagaccatccatttgctttcctttatcttatggttgtttttatataaagaggataaagggtaggagagcgacagccctatgttccagttgttattgtacatatccgctaatgttcgggagactggacgtgccaatgtgttcgacgcatatagcgataggctgggtagcgaggaggctttagtcaaacgtatatcattttgggctaactctgtttgtttccggagtagacgtatcgccggatcattggaataggcttgggctacataatcttcgtaagtttctaaagatacggtttggtccagtaacgtggtatctggtttgagcaatagattctcatcgagaccgatcaggatatccaattgctgtgataccagtatgaggctattatccgtttcttgtaaggataggcggtcgttggttaattgcatctcgcttcttaatacgtcgttattggttatcagtccctcttttttcatacgccggatatcttgcaggcggcgttccgattcctcgatattacgggaaagcacctcacgttgtttaaacaggctgaaaagaccgatgtattgatttaatagaccgagcttgatctcactctggtctgtgagcgtttgtaaagaggcgacttctttctccagatccgctttccgaatggaataccggattttaccgccttgatatatcggttgggtaaggtcgatggcatagttctgggaccaatcgggcgcttccgggcgagtcggatgggcgagtccttgctcaaagaggatcggttgccctacatatccacctttcaagccgatttgcaggtctggcaattgtgcggaacgtgccgtatgggttctctcttgcgctatcgattcttttaagacgtctgcttggatctgcagactatgccgtacgcctctctcgaaaagctggtcgatggtcaagaagagcgaatcggtttgggcgattgccggaaatgtagcgaccgtcatacaaaagaggctcaatacgtgctttttatatattctcaaggacattatgtactgcttttaattcggataacatggtttctacgttctctattccgataatatgctccgcatgtacataaacctgatcaaggatcgggcgaatttgctttttgaattcttctccttccggggttaggaaaaccagtttgttcctccggtcctcgggatcttctttccgatggacgtagcctttcttctctaaattgttcattaggtttgtcagacaagccttatcctttgccgttctctctgccaagacctgttgggtgataccttgttcgtgccataggcaactcaagatttgaagcatctcaaatgttataccggcgttgttctttttcagcgttcgttgcatagaccgacgaaatgccatgcgtgtgcggacaacttgtaacataagttcccggaattctttaccttctaccattacttataattcttttaaacttgctgggcgcgaagatagcgttttttctcggattagtcaaatgtttaactaattagcgtctcgctaataaagtatgtttgccatctaggtggcacagctttgccatcggcgtggcacgggcttgccatcactatggcacgggtatgccatcagcgtggcacagctgtgccaaggcgatggtagatgttggcacagtatgtgtatgaaagacaggtgtatagaatgaaggcgtaacaaacccgtggagtgattcgttacgctttctgtttagttctcgtttacgagtttaagatgcattcttctttatccaaacgcctccttcaattgcttcacccatcgctcgattcgtttgtcggtttgatccggttggttttccaaatcgaggactaagcctagtagtttgccatttttcaaggctttggaggcattaaagaaataatcatccgaagaggtctcgcctactaaagtcgctccacaggaggtgaaagcgtccgccaatatgccgactccatcggcgaaattatccggataattcgtttgatctccaagaccgaaaatagcgaccttcttatttttaaggtctaaagtgaccagttccgggatgatctcgtcccaataggtgggaagttcgccatcgaaccaagtagaggttcctgcgattatatggtcgtaagcctcgaaatctcttttccatgcgctttcaatagggatgatatcgatctgatcctccccgaaagcttttcttattttattggcgacaaaggttgttttctctgtgcccgttccgtaaaataatcctgttttcattgtgatgcttttaaagatttaacgaatgtggatctaataaagcagcagttcttttgccgcatgatagatggtctcctcgttggggaggatggcccgttccaagaccggatggaaaccaaccggagtgaatagggaacctacccgttggatcggagcatccaagtactggaatagttccgagccgatgatgccggcaatttccgctccgaagccagagaagaccttgtcctcatgtacgatcaatactttactggttttcttcaccgagttgaagatcgcctctttatccaatggtatcaaggtacgaagatcgataacctccagttcccagcctttttctttgtaaagaagctcggctacgttgaggcaaagatgggtcgtattgccataagtgatgattgtcagatcttttcccggacggcgtatgcgggctttcccaaatggaacctcgaaatcctcggggacaaaggtggaggcttctaccgcgttgtagagcgctttcggttccagatagagcgtaaagcctttagaacgcatactcgtccgcaacagtccggcggcatcatctgcgaaagagggataaacaatccgggcaccgggtaatgaggtcaatgcgccctcaatggtctgggaatgataaagccctcctccgatatagcctccggaggctaggcgcaaagtgatgtttggggtaaattgcccgttgctgcgccaatactcatgcgtacattccacgtattgctcgacggccggccagaagtaatcggcgaattccgcgccctcgatcactacatggatcttcgggtcaaagcggcacataccgttcgctgtccctacgatataatcctcggcgataggggcgttgaagactcgctcgataccgaattcttgctgcatgcctttggtgatgttgaatacgccacccttttctttattggctacatcctgtccccagataaacgtatccgggttgtgccggaactccgctttcaacgtcttgttgatcgccgtaactagcgtttctttctctccttcctcgttttgaacaccttctttgtatttttgaggttgataaggttccgggaggacgtaatccttgacggtagacggatcgggatcgggggcggccatcgctttccgattggcggctttcaggtctttagccgctagatccgcgatctctttcaattcttcctcggtgaaacgtccgtaacgaatcagcatgcgatggaatttgtataaaggatcggcggattttacataggtaagctcgttctcatcacgatacaaggtatgtttatcggagtttgagtgggagcctatccgtacgcaattggcctgaacgattacgggagtccggttggcgatcgcgtactctttggcctcggtcatggcattcatggaatcgaacacgtcttttccattgcaatggataatacgtaaattcttgaagccagagaagttatcggcaactttacgattggccgtctggtcctttttggggacagagataccatatccattgtcttggaagacaaagataaccggcagtcgctcattgctggcgccattgattgcctcatacacatagccttcggaagcggccgattcaccgtgcgaggtaatcgctacgcctttctgtccatagtaaaccatcgcccgtgccacgccggcggcatggagatcgtgagtcgccgtagcggaagaaacgttctcgatatgccattccatcttagagaagtggttagacatgtggcggccgccactggtcaggtcggtcgccttggagataccattcaggatgatctcctcggcggtcattcccgccgagagaaccgtcaacatatcccggtaataggggaagagaaagtccgtgtccttatcgaatacttgtcccatggcgagttgtatcccgtcgtgcccggcatacggggcatgataagaccagccgagagattgcaataaataggagggagccttctcatcgatcgcccttccgagcgtcataaggtaaaaccatttcctgagagtctccttatctgttgtttttatatcatactttttcatgttgttctattatatataatgtattaagcgttccaattctctagttcgtcggcgatggaacgtaaaaaggctcccgccaaagctccgtccacgatacgatgatcgtaggagagtgagaggtacatcttgtgacggatagcgatcgtatctccctcgggcgtctctactaccgcaggcttcttctcgatataaccgacggctaggatcgctacttgaggctgattgatgatcggggtgccgaacagactcttgaaggttccgaaattcgtaatcgtgaacgttccgccttggatgctatccggggcgagcttattctcacgggctttagccgccaaggtatctatttgtgaggcgaggccacttaggttcagcttatcggcatcgtgtataaccgggacaattaaatttccgtcgtttaaggaaaccgctatacctatattaataggcttctttaggatgatattgtaaccgtccacggatgaatttactaatggataggctttcaacgctttggcggtcgcttcggtaatagccggcatataagttaggttgatgccttcttgcttgaagaattgatccttcacttttttacgccagttaaccagtcgggtcacgtctacctcgataaccgacgtcacatgcggagatacttttttcgataataccatatggtccgcaatgatcttacgtacacgatccatttctctcacctcgtctccttgagcgagtggagcggatggggtggccgctgtcataggcatggaaggagcggtcggcggcgctaccgtaattgttggcgtgctcgtagccgtttgctgcatggaagaaacaggagcctgtttcggcttcggcatttccgtacctttatttttgtgatcgatatacgtttgaatatctttcttactgagacgtcccagatatccggtacccggaatatgatccagttcatcttgcgacacaccggcagctttcgctaattgcaatacgacgggagaataccaacgatcttcctcttgggaattctttgataattcctctgggacgggagcggggacttgttctttcggttgagtagcctccgaggtttccggctgaactccgttatcctctccttcaccttcgatctcaaggatcgctacgactgtaccgaccgctacggtgtctccctcattaaaaagaagttgttttacttttccctcaacgggggatggaatctcagcgcttactttcgctgtgcttacttcgaaaaggacatcatcttcctctacggtatcacctacctttaccgaccatgagatgatggttccttctgtaatactttcgcccaacttaggcatctttatctcaaatgtagccatattttgattttttaattactgttatatagtgggagacggggcgtgccccgtctctacaaacggtatataataagaacaaagatcaagaaggtaagtttctgtattatagtgtataagtgttaaagttccagctggctgtagcatatttctgctctttaagccgatagatggcttccaagtctgcttgcgtgaaataataatcttgaataccgggattattgatcgtgaaatagtaaagaagcgctttcttaaaatgctggatggagatagaagccggaagatgggcgctgatattcgtgaccggactccgtacagatttaacgaatgtcgatcgtttacctcctgttttctttggtgtttgatgggatgtacttttcaaggaggtgacgagcctatccagatcggtggaaaacaataaggtagcatggtgtatataccgattcttatggatactctgtgcgctacccgatattttaaatcctccgatagttaatcctttccgttcatccacctcgacatgtactcccaatgtcttgagaaaattcatgatctggatggtatatttgtcggtctgcataatctggccggtctctataaatgtaagattcaggtttcccggatcatggtaaacggcaccaccaccggaaaacctgcgtgctatcttgatttgttggtcttgtacgaatttgagatttacctcggcccatacatcctgatgcttaccgatcacgattgatggttcattctgccaaagcatgaaaatattctctttgaaattcttgagcagatactcttcggcggccaaattgaagtatggatccgtttgtgtattgtgaatgcaaagcatcaggaaactgttttagttaggcgttttattagatatataaactttcgtggaggatctcactgactgtcggatgcgggaaaatatttttcttaaattcatcgattgtataaccattctcgacagcgattccggcggtgacgataatctcggatgccggattccctagtagatggcaaccgatgatacgatcctcgtcgtccgtgatcagtttacataaaccattaccattctcgttctctgcgacgaaacgtccggaataggtcatcgggatcttttgaacacgaaaactttccccgttcgctaccaattcctcttctgtcttacccacgctcgccaattccggattcgtataaactaccgccggaatggctttatagctcatctcgtccggtatgcctaggatatggtgtatggcaacttccgcttcccggtaagccgtatgtgccagcagggaaaaaccggtaatatctccagccgcatatacatgtggatgggaagtcagcatatgttcgttcacctttacgccggccccttgtatttcgatcgctagattttctagtcccagactctttgtaatcggacggcggcccacgctcaccaatattttatcggcttcaatcgtgtctgccttgccgtttttctcaacaaagactttctctgccgatacctctgaaactttggtattcaagaaaaactctacgccttttttcttatactcggatcgaagcatcgctgaggtttctttatccatattccctaatatctcgggtagcatctcgattaccttcacctttacgcccatactgttaaagaatgaggcgaactccattccgatcacgccaccaccgataatcgctaacgattttggcaaatcgttgagatcaagggcttcccgggaagtccaatacttgacctctgataaccctttgataggagggatcacggtttcagagcctgtgcatactaacacattcttcactaaatactcttttccatcgcagtgaatccgtatatttccaaactcctctccggtgattcgtgcctctccttctacgatggtgacgccgttacccgtaagccgggcttttaccccgagcgtaagtttacggacggtcttgttcttccggtcgataatctttgccaagtcgaaacttgggtctttcatcgccactataccatatttggaggcacttttgatactgtctagtatcttggcggagtataaaagagtttttgtcgggatacatccctcgtttaggcagacgccaccgatagcgttcttctcgaaaaggatcgtttttaatccattctccgaagccctttcggcggcggtgtaacccgcaggtccaccgcctatgattgctatgtcatattccatatacattattataattatttgaatactaaaattcgttcctctaatggagcgaattgtttttctcccggttcctgggtagaggttccgaacggcatctcggcgatcagtttccagttcggattgatatgccattgtttagcgaccgcctcgtcgatcaacgggttgtaatgttgcaaagaagcgccgaagccggcgtcttccagcatagtccatactgcgaattgatgcatagccgatgtctgttgggaccataccgggaaattctctttataagaaggaaattgcttctgtaagccttctactaccgctgtatcctcgaaaaagaggaccgtgccatagccagcctcgaaagaattatctatctttgcctcggtagccttataggcttcggcggggacgattttacgaagcgtgtcttttacgatttcccaaagcttcttgtggctttcacccagtagcagtacgattctcgtagactgcgaattgaatgcggagggaacgtgagtgaccgctgtcttaataatctcatgaatctcgttgtcggaaatgggagagttgttacctattccataatgtgtccggcgatgctggatcgcttctttaaaacttcttgccataatgaatatcatgttatgttgttatatacctataactaatttaagacatgatttgttgaggaaaaaatatttgagaattcttgcggataaatcaaaataattcttacctttgcaccctgtaaagataagactctattagaatcttcgtttttgttcatgatgctagttcagaaagggaagacacatagcaggagttgacttaaatttcgtataatttaaaagaacagattagaaatgtctaaaatttgtcaaattactggaaagagagcaatggttggaaacaacgtttctcactcaaagagaagaacgaagcgtaagttcaatgtcaacctgtttacgaagaagttctactgggtagagcaggattgctgggttagcttgaatatatctgcggctggcttacgtacaatcaataagttaggtttggatgcggctatcaagatggcggctgaaaaaggttatttgaacgcataatttgtggaggatatagaaaatggcaaaaaaagcaaaaggaaatagagtacaggtaatccttgagtgtacagagcacaaggaaagtggaatgccgggtatgtctcgctatatcactacgaagaatagaaagaatactactcagagattggaattgatgaaatacaatccggttttgaagaagatgacgttacacaaagaaattaagtaataggagattttaaacgatggcaaaaaaagcagttgcaacatttaagaaaggtgacggtcgtacttattccaaagtgattaaaatggttaagtctccgaaaacaggtgcatacatcttccaagaagaaatgatccctaacgaagcagtaaaagattatttcgctaaataattaagtagcgaataataaagaatataagaggcttctctccgataaagcggagggaagctttttttgtaccctaaacttttgaaagtatagttggttacaaataaaatattttcttaattttgttgggttaatttgtagagatggggtatgccgtgtctcttcccatccaaatggtagtttgtgtgaaataataatataacaagataaaatattaaagctatgagattcgatgtatccagcactgcgctattatcacgtttacagtctataagcaaggttatcgcttccaagaactctttaccgattctggacagcttcctttttaacctagaaggaaatacgcttacggtgacagcttccgatgccgagacccggttggtgacttccgtagacgtcatgaatgcccaaggtgccggactctttgcggtttccgccaagatactgctcgatccgctgaaagagcttcccgaacaaccgcttacttttgatatcaatgatgagaatttggagattttcattcatttccagaatggtaagtataattttatcggtcagaaaggggacacatatccgcagcagaagccgttgaatgataacgctatctctatctcgatggatgcccagatgctgttaaacggcatcagtcgttccttgttcgccacggccgatgatgagcttcgccctgtaatgaatggtgtctatttcgatatccatacggatgatttgacgttcgtggcatcagacggacataaattggttcgcttgcgtaacttggcggtgaaatccccggaacgggcttctttcattttgccgaagaagccggctaatttattgaagaatttgttggcgaaggagtcggagcaagtattgattaagtttgatgataacaatgcgtatattacttgcacgaacttcgagatggtttgtcgtttgatcgaggggcgttacccgaactataatagtgtgattcctcaagaaaacccgtttaaggtaacgatcgatcgtatctctttcttgaatgctttaaagcgtgtttctgtcttttctaatccggcgagcagcttggtgaagttgcacttgaaggatagcttgattacggtttccgcccaagatatcgatttctccacttctgcggaagagcgtattgtttgtcagtttgacgggacggagttaagcatcggttttaaggctacatatctgatcgagatccttggaaatatcagctcggaagaggttgtattagaattagcggacccttcacgtgccggcttgatcgttccttctgagaatgatgaggacgaggacttgctcatgttgctgatgccgatgatgttgaatgactaataaataaataatgcagttaaacttaaggaacccgctggtcttttttgatttagagaccacgggtataaatatcgtaaaggaccgtatcgtagagatttcctacgtgaaggtcttcccaaatgggaaagaagaaacgaagacacgccggataaatcccggtatgcctattccccccgaatctaccgctattcatggcataaccgatgaagatgtaaaagattgtccgacctttaaggagatcgctaaatctttggcaacccagatcgagggttgtgatttggccggatataattccaaccgttttgatatacccatgcttgccgaggagtttctgcgtgcgggtgtggatatcgatttgaaccggcgcaaatttatcgatgtacagacgattttccataagatggagcaacgtacgttatctgccgcttataaattctattgcaataaaagcttggagaacgctcatacggctgaggctgatacattggctacgtatgaggtgttgaaagcgcagctggatcgctatccggatttgaagaatgacgtagctttcctttcccaatattcctgctactcgaataatgtggatttcgccggacgtatggtttacaacgataaaggcgaggaggttattaacttcggtaagtataaaggccgtttggtaacggagatcttgaagtcggatccgggttattattcttggatcatgaatggcgatttcccgttgaatacgaagaaaatgttgacagagatccgtttgagagactttaattcaaaataaggcgatgaataattttgagttttgcaatcctgtaaaggttgtgttcggcaaaggaagtattgcccgtttgtctgcgttaattccagaaggaagtaaggttctggtggtatacggtggcggtagcattaagaaaaatggcatttatgagcaggtgacggcagctttgaaagacttccatacctatgagtttggtggtatcgaggcgaatccccgttatgagacttgtatgaaggctgttgagttggtgaagggggagaatatcgatttcttgctggcagtaggcggcggatcagtgatcgacgctacgaaatttatcgcttcggctacgtttttcgagggagatccttgggatatcttatcgaaaggtggcgtgataaagaaagcgcttcctttaggagtagtgctgactttggccgctaccggttcggaaatgaatgaacgggcggtaatttcccgggaatctgttcatgagaaattgaatttcatgtctccgttggtgttccctaagttcgctatcttagatccgcaggtaacttattctttaccagagcgacaggtggctaacggtgtcgttgattcgtttatccatgtggtcgagcaatacctgacttatccggtgaacgctaaggttcaagattattttgccgagggattgatgaagacaatcgtggaagaaggccgcaaggtcttgcaaaacccgaatgattatgatattcgtgctaatttgatgtgggcggctacgaatgccttgaactgttggattggccaaggagtaccccaagactggtcctcacaccgtatgggatatgcattgacggcgcagtttggcttggatcatgcccagactttggcggttatcttgccgggtgtcatgacctatatgcgtaaggagaaaacggcgaaactgatccggatgggagaggtcgtatttggtattaccgaaggatctgccgatgaaaaggcgcaaaagtcaatagaggctacggaagattttttccatttcatgggattaaagacccgtctttccgactatgggatcaaggagtccgacttggatgctttggtggaacctatcgatcgaatgggatggaaacttggcgaatatggcaatataaactcaaaagtagccaaagagattcttttgttgaggttgtagagacgcaacgtgctacgtctctactggcaaagataaattgattcgatatatgacattgaaagataaacatattatattagggattacggggagtatagccgcatacaaagccgcttatatcatccggggattggtgaaaaaaggagccgaggtacaagtggttatcacgccggcgggaaaagagtttatcactccgcttacgttatcgacgttgagtagccaccctgtaatcagcgagtttttttccaatagggatggtacatggaatagccatgtggatctggggctttgggcggatgccatgttgattgctccggctaccgcttccacgatcggtaagatggcgaacggaatcgccgataatatgctgataactacttatctttcttgcaaatcccctgtattcgtggctccggccatggatttggatatgttcgctcatccgagtacccaacagaatctggagcgcttgcgttcattcggtaaccggattatcgaacctgccgagggggaattggcgagccatttggttggtaaaggccggatggaagaacccgataagattatcgaggttttggaagacttctttttcgctcaaaaagatcttgaaaaaaaaaagatcttaataacagcaggtccgacatatgaaaagatagatcccgtacgttttataggtaattactcttccggtaagatggggttcgctttagcggaagcttgtgcggagagaggggcggaggtgactttggtcgctggtccagtctctttaaaaacacatcatccggctattaaacgaatcgatgttgagtctgccggggaaatgtaccaagcggcgatgaccgcattcccgagtagcgatgctgccatattatgtgccgctgtcgccgattaccgtccggagaatgcttccgagcagaagatcaaacgggaaacagagggagagatgacgcttcatttggttccgaacccggatatcgccgcctctttgggtgcgatcaagcgggaaggacaggtcatggtggggttcgccctggagacgaatgacgaggccactcatgccgaaggtaaactgaagcggaagaatctcgatttcatcgtcttgaattctttacgagaccaaggtgccggtttccgttgcgataccaataagatcacgattatcgacaatgccggaggagtaacgagctatccgctcaaaacgaagcgggaggtagcctctgatatcgtaaataagttggtaacattattgaaatgagaaaagtaagaagactgttttatctattcatgctttgcgccgctcctttttgtgggaaggcgcaagagttgaacgcccgtatcacggtaaacggagacaagatcgcgaccgctaataagcaaatcttcacgaccttgcagaactccttgactgagttcgtgaataaccggaaatggacggatgccacgtttgctgtcaatgagaagatcgattgtacgatgacgattatcgtgaatgaattggatgagacgaacttcaagagcgagatccagatacaagcccgccgtccggtctataattccagttatacaactactcttctgaattttagggaccaacagttggattttgaatatacggagggagagccattggactataactcaaatacgctgaccagcaatcttacggccactatcgtgttttacgtctatgtgatcttggggcttgatttcgatagtttcgccccgaaaggtggaactacctatatacagcaggcccaacaaatcgtgaacatggcccagtccgagatgtcgtggacgggctggaaagcttttgatagcaaccagaaccgccatgccgtagcgacggctttgcaagataacgcatccgacgctttccgggaaatgtggtacacgtatcaccggaaaggactcgatgaaatggcggcaaatccggatcgcggacgtacgacgatcatcggtgcgcttcccgccttgcaggaagtaaagaaagcccggcctacttctgtgcttctacaaatgttcgccgacgctaaattagatgagattattgcgatttattcgaaagcgaccacacaagagcggcaagagggctataagatgctgttcgagatctatccggcacaatccactcgcttggaagagcttcaaaaaccagtaaggtaaaatagttatgttgaaatccttatttatacagaactttgtcttgatagacaatttggatatccgctttgataaaggcttctcggtgataacgggtgagaccggagcgggaaaatctattatattaggagccttgtcattggtgctgggacaacgtgcggatggcaagagtataaagaaaggttcggataaatgtgtgatcgaggccgtatttgatgtctcaaaatatcagttggagcctttcttcctaagtaacgaccttgagtacgacgcggatagctgtatcttgcgtcgggagctttatgcctccggcaaatcccgtgccttcgtcaatgattctccggtttcccttacgatcttaaaagagttgggaagccgcttgatcgatatccattcgcagcatcagaacctattgttgggcgataaccgtttccagctgaaagtgatcgatgtaatggccgaaaatgagatcttgctcattctttataagaaggaatttacccgttatcaggcgttgcgaagggaactgaaagatttgagggacaaagcggctcaaagcaagcaggaggaagactatatccgttttcaattggaacaactggacgaagccaaccttcaaccggatgagcaggatgagttggagcaagagcaagaaactctctcgcatgcggaggagatcaaaagctctttatataaggtaaccgaactcttggacggcgaggagcaaggagccatccaaatactcaaggaagccctttccaccgtggattccttagaaagatatttcccgaaagccaaggaaatctccgagcgaatccgctcggcttatatcgacttgaatgatctggcttccgagacagacgttttaaaggaagatgtagagttcaacccagaacgattggaatgggtgaatgaacgcttgaataccctttatacgctccagcaaaaacaccgtgtctccaccgtggatgaattgatcgctatacgggatcaataccaagagcaattgcgtgcgatcgattctttcgatgagcaaatcggtttgttagagagtcaattggatgcctcgtataaagagttgcttcaacaggcctccgtgcttagcgagcagcgtaaagtcgcttccacggcgatggcctcgcaattggtcaagatgattattccgttggggatgccgaatacccgtttccgtgtggacatccttcctcgcaaagagccggagagcgatggaatggacgatatccgatttatgttctccgccaataagagcgcggaattgcagccggtagcccaaaccgcttccggaggtgagatctcccggttgatgctctgcattaaggctatgattgccgggttcaccgctttacctactattatctttgatgaggtagatacgggggtatcgggtgatatcgccgataaaatgggggatatcatgcaagaactcggaacaaagatgcaagttttcgctatcactcacttacctcagatagcggcgaaggggcaagctcattattttgtttataagaaggataccaaagaccgtacgctgacccgtatcaagcaattagagggggaggaacgtgtgaacgaggtggcccgtatgttgagcggagcctcgttgacagaggcttctcttgccaatgcgaaagatttgttgggtatcaaggattaaacctttctgaagtagggcagtcttagataaaagaacaaacgattcgctttattattaacttaaaattgaaaagacatgaaacgattcagcttactatgtgtgttggctatattgtgcagtttacccgcttacagccagttttggatcagttttgggtggaatgaaccgcattgtcaaaattgtctttggatggagcaagcgatgcatttgcccgctcgccaagcagcggaataccataagatcatccataagtacggacagaaaatagagaaggaggcccgccgtgactatcggtattgggaccgggcagctcgtcgtatttacgatttgcgcatggaaagggatcgtaagatccaacgtatattgactccagcccagttcaatctatatgtccgttttgtaagggagcatccgcaacgtatccatgattatcggggatggtatgcgaatccgagatatccggatcgccgcccgtcccatgactgccgtcgatatgaggataactattggaattaccgctggagtaccattcaccatgacaatcattggagagacgaccggcatgactcagatagacattgggatcgtgacaaccatcgtcatgactatcggaaaccagcgaaaccggataagcccaaacctaaaaagaataagaaggatcgggacgatagaaaagaacggtattatagcaatgggcgaaaggtctaataattcaaccatagcttgaaagaggcccatttttctttgctgaccaatattttctctttatgttccggctttatgtggacaatgaccttattctgaaaatagggctctattttcacgatggattcgatatttatgatcgtctgccggttcgtccggaaaaatttatcgggatctaattgttccatgagtttatccagcgggaaatcgattatgtactccttgttttggcgtgtgacagcgaaggtgatcttgtttaatgaataaaagtaggcgatatcctccacctgtaaagtgatcagtttctcgttgccggaaataaggaaacgggtcctgtatttcttgccgggatacgtgagggaatggagtacttccaataaatcattttgctctaagagcttctggttgtacttagacgtgacatgctcgaatttttggatggcttcttccaatctctcttgtcgtatcggtttgagtagataatcaatactgtttaccgtaaaggcccggactgcatattcatcgtaagcggtcgtaaagataatgagacttgtaggacaagcctgttctataaataaaaaagaatttccatccgacaactggatatccagaaaaacgatatccggatgcggatgggaagcgaaccaagccacggatgattcgatgcttccgggtatcttgatgatatcccattgcgggcgtaatttctttatcataccttccagtaaccgggcggccggtttctcatcttcgataatggctacttgaatattattcataaataagtgggattgatacggtgaattggtgatcatttttacggatttggatatcctgcttacatagtaattgataacgctccgacaaattctttaatcctttaccggatgcgtttgagacttttttaggtcgtaatgtattgctgacgcatagatatcgaccgttcttttcagtatatactcgtatggtcatcgggttaaaatcgtcgatataattatgtttcacgacattctcggctagtagttgcagtgtcagtgggggcaattgatggtcaatgacgttgtggggaagatcgcgttccaacgacaaacaatctcccagccggacttgatggaggaatatataggaatccagaaaatcaagctcctcttttaaagagacgatctggcactgttgctggcggagcacgtaacggtatacctcggatagatgctgcgtaaacttgaccgccgtagatggatcatactctatctccgctatcaatgtattcaagctattaaacaggaaatgaggatttagctggctttggagagcggtatatttagcttgtatagattctgcttccaatctttgtttctccttatataaattcaatgtataacgcatcgaataattaatcaagagaaggctgaaaatgatcatctccacgaaccagacggctattaccaaaccggccccttttgcccggatcacgaaaggatcgccaatgcttgtgatccatttcaacgagataaacagggtacaattcataagtagcaataggatcgctaccagcagataatgccataacattcggctcttatcgatataatacaatgggtaattggtagccatccaattactgctgaccagtaaactgaaaccgaacaggttgaataccgctatcgtgatggataaagcgatcaatgagatttttatatcggggatgcgctcttgtagctccgtatgatataacagcaagaaataggaaaagacccctaatgccgaaaacaaaaggatacatgccgatttcccgtatgatatttctttcatgacctattctttttcgcgaagataataaattgcccgttcgaaatccgtcttcgccatctgtgcgtttagtttggattgtatataattaacctgagcttgctgatgatatagttgagcgttgataacctcgacgatggaaacattcccctccttataacgctccatggccatttgttcactttcggatgcttttgataatgagctctcggttagtttgactttatcgatagcttgcttatagttgtaatgggcggtttgtatttccagccggatcttatcttgcgtcttgctaagattctgttgagccatattgatggcgtacgaggaagcgttgcgggtactcttacgttttccccattcgaagagcgggatactgagcttggcgtagatcgcatagttcggatctaggtcggatttgaagttatagcccggtgaggaataacttccatctactccaatatggaattggggtaagaaacgggcatctgctattttccgggatgattcctgtaactcgatcttgttttgggcgatccggtattccggcctgctggttatcgcgttatctatcgcatccgataaagggataaattgtttgagggcgattacggaatgatcgatcggcaaggtatcgctcgggtttacaccagcgaaagaattaagggctaaacgtgcgatctcggcgttatcacgagtttgcaataactggaaatctgcgtcgtttagttttacctctgccataagaagatcgtttcgatcgatatattcgacttctacccggtggcgtacgacctctaccagttgctgtatagatgtacgaaatgcctgtgccacgaaaaccagctcgtgttgggctactgcgttccaatagtagatatcggcgtcgtgtagggtattgctttttatacgattggattcattggatgccaactctttttccttccgtgctttttggtagttggcacgaatgccgcctccggtataaatcggttgtgatagggagagagtcgccccatatttcagatctttaccttgaaaataaaggggggaactcatagatggcaaatcaatcgataattctagcggattaccggtataattgaaattacctcccgccgagagtttcggtttgaaatccgcacgggccgatttgatcatttcctgtttcatggcctcgttgtatcccgctgctttcaagtcttggttgtattccaagactttttccctatattgcgcttgataatcgctgttttgtgcgattaacgggaaggataggaaggataagagaccgctgataatatatactttgtccatttttatcgtttatttgtgaggtgaatgaatccggtaaaacaatgcgtataacgtcggggttacgaataacgtaagtaaggtggcgaaggtgagtccgaagataatagtcgccgccattccaccgaacgctacgtcgaaaagtaaaggcaccattcctagaatagtcgtggtagccgccatcaagaccgggcgagtccttgagatggttgcctctatgatcgagtcgtatggagagataccgttacgacgttgcgtgttaatctcgtctaataatacgattacgtttttgataatcatacccaagagtcccaaccatccggcgatcgggaaaaagccgaaatcgaacccggtaagtaacataccgatcgctaccccgattaaggagagagggagcacgcaaaggatgattatcggttgacggaaattggagaataaagcgaccaatataacaaccaacatcaagaatgccaacggaaagaatttgacaagggcttgtaatccctctgtctggtctttatattgtgaatcccagaagaagctatatccttggggcaggttcattttctcgatctcttcccgaatctcaccatgtacctcagacatggtgtaaccgtttttcacgccacacatcgctgccatagacaattgccggttgtaggtcttgatctgcggatattcccatgtagaggttacttgttgggttacttgcgacaaaggagcggatttctctccattccagaccgagaaatcgcctaatgaatggggatcattgattccgctcgtctccgatttcaataagaccgggactttcttttcctcatcccggtaaatcccgataaccgtaccttcctcgatggatttgacggattccatcaaattggccttggtgatacctaaggaaccggcttttaccggatcatataccgggcgtatcatataggtcatattaccccattcattccgggcatcggctactttcgggttccttcgcataatgtcgatagctactccagccaaagagtccaataccgccgggtccggcccgaggaaacgggcttctatcaaggcttccgtaagcgggcttaactcaaacttgttcaccttgatgagcggttccggatattttaagcgaatagagtcttgtagcaaggcatgcaattcccgggcctctccggatgtcttacattttaccaataattgggcatagtttggttggggaccgaagctaacgttcgatagataataacggggcggtgtccgtccgatataagaggaaaccatttccgtctgcgaatattcttggatggattcggccatatcggtagcgtatcgatcggtttcctcgatggctgtaccttccggtagccacatatctaaagtgaaatactgcttatcgagcgagggcacgaacactttcgggataaactggaaactccatgcggagataaccaatagaacggataagatacctactgtagcgtatcggtatttgatgacaaggcgtagggaagaccgaaaataatcatagtattttccggagaataattcccctgttaactcgtccggtctggggcgccgtacaaactcttggatgaagaatggggtttgcgtaagcgcgaacacccagctgaacatcaaggatactccgatcacgatcactaaagatgaaagtaattcgcccgtgatatgcggtgaatagtaaatgggcaagaacgtgaggatcgcgatagccgtagccgccagtagaggcagggcggtggatgagcaagccctcatgatcgcaatacgtttgcgcatgcctcgttgcatatttaccaaggcagagtccgatactacgatggcgttatctaccaacatacccatcgcgatgatgatagcggcaagagacattcgttgcaaggcgatcccgttggcgaacatgacaattaaagtggcgaagatagagaaaaccaatccgctaccgatcaaaaggccgtttttgaaaccgataaagaacaataagatcgctactacggtcacgacggagatgatcaagttcaagataaatccttggttggccacggcggactcatatccttggtcgtatatggaggtgagctcaaaacccttgggcatggtctccgaaaatgattgaatacgctttttcacggccttggccatatcgaccacgttcccggtcggtatggtagagatagcgataccgaccgcttgcttgttattgatgcgcatgaagttttggggcggagtctggtaaccctcttcgatacgggcgatatcgcctagccggaaatgctcgccggaatgagatacgatcgtaaggttacggatatcatccaaggagtaaaaattaccggtggattcgatacgtatgcgagtctccccgttgcgaatactcccggcgtctaccactttattctgtccgtcgaacgcccgtttgatatcagctgtcgtaataccccgattggataagatcgtggggtttatccggatatcgattacgggagtttgtatgccgtagatctctacctttgccacgtcttttactttcagtaaatcgtctttgatcagtttggcttgatcctccagttcccggtaggtataagattctccggtcaatccgtagaaaacacccaatacatcgccaaaatcatcattgacgatggaggttcccgctccggaaggtaatttgccttgtacgtcgtttacctttcggcgtagtttatcccataactgctgcatctcgtcggcccggatttcctttttcacgtagaccgtgatcttggaaagtccagcccggttctctgtcttcagatagtataactcgcctaaggattgaatggcttcttccagcacatccgtcacttgggactgaacttccgagggggaggcgccgggataaggggtaagtaccaaggcttgcttgatcgtaaacggggcatcttccagttttcccatctttgcgtaagagaacagtccccctgccaagatcaggactagcaggagccatgtaaccgctttgtttttcaggaaatatttgatgaatttttgcatcttacttatttttggatggttacggtactattttcggaaaggaaacgttgccttgtcaatacgacaaggtcattttccgtgattccttccacgatctctatctggttatttctttgctcaccgagtttgacgggaacggagttaaccttgtctcctttaaccacccatacataatctcctttttgggggcgatgacagatagccgttaagggaagccatagattttgagaccgctcttctttgggtaggtcgatcgagaggattccactcattccgcccagccattccatatctggatttgggacaatggcggtcagcagataagagaggttattgtttgtcgtacttttagacacatataaatcggaaggggtgattgtccgttcgggagccgtatcgaaatggattcctacttgacatagcttctgtttttctttatcatataagtgtaaggcgacttcctctggtatataggtctcgatcttgagcctgtccagttctatgaaggtaaggattggctcggtcgctttcacgtcttggaaaggttcgatatggatattttggatatatccgtcgtaaggggcggacagatgggtatcgcttagggcgttgacggcggtctcgtaattggatttggcaacaaggaaatcggctttcgccttctcataattacttccggagatgttattctttttgtaaagggcctcgatccgtttatactcttggttggtttgcgaatagagcgcctctgtttgctgcttgcgaatcaagaagtcacggttatcgatcgagaggatcgtgctgcctttggagaacgcttgtccgggccgtaagtcgaaatttaagacggggccattgatgcggaaagataggaccgtctcattgtagggccttgataaaaaggtgtattcacgacttctgccgatctctgtcttttttattggagagatcacctcgacaggtaagttcgtgccttcggactttgtgttcttttggcatgccgataaaaggatgcccagaagcaggatgtatgaaattcttctcataagatatacctagttatttgttaccgggcaaaaatagaggcaatggatgaaggaataaggtggatttttactgaaccggaagataccgtcgctcaactggaaaatagaccggcccaaccttaatttataacgaggcggacgatggatgccttataccgtgtatcactataggcaatgcccactgcaacgcctgtgcagtgacaattagaaccggtgatacggtgagtaagcttccgcggttccgcttttttatgtacttttgccggcaaaaaaggagaaagtaatgacattgccttcagaagaacatatattccagtatccgggacaagggcggatcgaggtgatttgcggttccatgttttccggtaagacggaggagcttatccgccgtttgaagcgggctaaattcgccaagcagcgggtggagattttcaagcctgcgattgatacccgctattcgcaggataacgtggtctcgcacgatagtaattcgattccttctactccggtggattcttcctccagtatcctattgttcacttccgagatcgatgtggtggggatagacgaggcccagtttttcgatgagggattggtaaacgtgtgcaatcaattggccgctaacggtatccgggtgatcgtggctgggttggacatggactataagggagttcctttcggtcctatgccggagctatgcgctatcgccgatgaggtgacgaaagtgcatgccatctgcgtgaaatgcggacgtttggcttacgtatcccatcgtatcgtgggaaatgataaacgggtctttttaggggaacaatccgaatacgagcctttatgccgggaatgctatgcgaaggctgaaggtttgaagaattgattatttatccctacatttgtgaaattaatagttttgcgttatataaagtatgaaagaaaacgagatggtgttcggcattcgtgccgtgattgaggctatacaggctgataaggaggtagataagatccttgtgaaaagggatttacaaggggatctatccaaagagttatttgaggtactgagaggccgtgagataccggtacaacgtgttccggctgaacgcttggatcgtttgactcgaaagaatcatcagggggtgatcgcttttatgtcggcggttacctaccagagcttggaagatatcattccttttgtgtatgagcaaggaaaagatcctttcatcgtattgctggatggggttacggacgtgcgtaatttcggcgctattgcccgtacctgcgagtgtgcgggagtcgatgcgatcgtgattccggcaaaaggaagcgtttcggtaaacgccgacgcgatcaagacctctgccggcgccttgcatgtattgccggtttgtaaggagaagagtatcaaccaagcgatccgtttcttgcagcaaagcggggtgaaggtatttgccgccagcgagaaagcggcggagaattatacggcggtgaagtatgaaggaccggtagcgatcgtgatgggagcggaagatacgggtgtgtctccggagaacttgcgcatctgcgataatatggtaaagattccgcaattcggaacgatcggttccttgaatgtgtccgtagccacttccattttggtgtacgaggtggttcgccaacgtatgaacgagcaacaataataatatgtatataaactaaagaagaaaatgaagaaagttatcgctacaaaaaacgctcccgccgctatcggtccgtatagccaagcggtgcaagtaggcaatatgctgttcgcttccggacagctgggtatcgatcctgctacgggacttttcgttgagggatccgtaaaggaacaaaccgcccaagcgttcaagaatgttcacgctatcttggcagaggcaggttatagcatcaatgatgtcgtaaaaacaaccgtatttttagcggatatgggcgacttcgccgttatgaacgaggtatacgcctctcagttcgaaggtgcgtttcccgcacgttcggcggtagccgttaagacactgccgaagaatggtttggtagagatcgaggtgatcgccgtgaaagaataatcataaggaataacgagagtagtctcatcacttgtcgagactactctcgttatccatcaagactactcccgtgatacgatgcgactactctcgtaattcatcgatacagctaatctcaaaagcctattatcttctttttctgggagcgggattcatgtcacccctctgtccgaataatttctcaatcaaatcctttcgtcccatcttttgcaatacttgcatgatctgacggcgtgactcgggtttataccagaagaagaactggcgttgtgccaacttttgttcttttgagcgggccgtatatactttctccaacgtataaggatgatatccggtataatacatctccgtagccaatgtcatcggcgtaggcgtgaagtcttgtacttgctccaactggaaatgcaagctcttggtgatcactgccagttccgccatatccgcctcggtacatcccggatggctggaaatgaaataggggatgagttgctggttcaacccgtattgccggtttaccttatcgaatatcttcttgaactgtccgaattgcgagaaagacggtttacgcatttgtttcaacacctcgtcttgcgtatgctccggggccactttcaaacggccggatacgtggcgggcgattaattcctcggtataggtttgagctgccttgtttaaagactcatccgcataacggtgcaataagaggtcatagcgtacgccgcttccgataaacgatttcttgatcccgggaagtctatctaccgctttgtagatatccagtagcggcgtatggtccgcgttcaagttcttgcaaacgacgggggagatgcaagacggtttcttgcatttggcgcaaatccgctcatctttccccttcatacggtacatattggcggaagggcctcccaaatcgcttagatatcccttgaaatccggcatttcggtaatcgctttcacttccttcaagatcgattccttgcttcgggaggcgatgaacttcccttgatgcgccgatatggtacagaacgcacatcctccgaaacaaccccggtggatattcaccgagaacttgatcatctcgaaagccggtatcactttccctttatatttgggatgcggcaagcgggtgtagggaaggtcgtaggaggcatctatctccgcttccgtcattggagggaagggaggattcaccacaatcacttgctttcctaccttttgcaagatacgtgaggcattgtatttgttggattcctcttcgatataccggaaattcttcgcttgtttcaatttatcttttaggcattcctcgtgtgagaagagcacgatatcatcgtctttcgcatcctctttgtctgccagataaaccgtttggcggatgtccttgatctcgttgaaaggaatgccggactttaggcggcgcaccaactccttgataggcttctcgcccatgccgtaaatcaataaatcggccgggctactggcaaggattcccggtaatagcttatcttgccaataatcgtaatgcgtaagccggcgtaatgaggcctcgatgctacccaatacgacggggacatccggatacaattctttcagtattttagtatagacaatgctcggataatccgggcgcattcccggacgttggtccggcgtataggcgtcgtcgctgcgtaatcgcttattggcagtataatggttgatcattgaatccatggcaccggcggatacaccgaagaaaagccggggaacgccgagcttcttgaaatcccggtaatctccccgccaatccggttgcggtacgatcgctacccgtaatccttccgcttccaatacacgaccgatcacggccgccccgaaagaggggtgatccacataggcgtctcccgagaaaaggatcacgtcgaggtaatcccatccccgtgcctcgacttctttcttcgttgtgggcaaccaattgtctagtttaaatgttttcataatgcaaaggtacgtgataatcttggaataatcatagagacgctattcataacttttatttatgggggattcgtttttatgattaggacaagagttctcaatctcgtatctttgtgtcgaaaagaaaaataaacatttaaaaacaaggtttcttatgaaaacactcacagacgagaagctgacgattgtcggcgcagcaggtatgatcggttctaatatggcacagaccgctattatgatgggactaacttccaacatttgtttgtacgacccttacgcaccgggtttggagggagttgccgaggaattattccattgtggtttcgagggtgtaaacatcacttttacctcagacatcaaggaggctttgactggcgctaaatatatcgttaactccggtggtgccgcaagaaaggcaggtatgactcgtgaggatctcctaaaaggaaacgccgctatcgccgaggagttcggcaagaacgtaaaggcttattgcccggacgtaaagcatatcgtggttatctttaacccggcggatattaccggtttgattaccttattgtattccggcttgaaaccgtctcaggttacgacgttggccgcattggattcaactcgtttacgcagtgagttggcaaaacatttcggtatctctatggatcaggttgagaattgccgtacgtatggcggtcatggcgagcaaatggctgttttcgcctctaccgctaaagtggatggtaaacctttaactgagcttatcggtacggatgccttgacgaaagatcaatgggcggagatacagacaaaggttacgaagggtggcgcaaacattatcgccttgcgtggccgttcttccttccaaagcccgtcgtatgtatctatcgagatgatcgccgcggcaatgggtggtaaaccgttccgttggccggctggcgcttatgtatcaaacggtaagttcgatcatatcatgatggcttgggagacctcgattacgaaagacggcgtaacgttgaaagaggtgcatggtacaccggaagaagaggctgccttggagaagagctacaagcacctttgcgctttacgtgacgaggtgatcgctatgggcgtgcttcccgctatttccgaatggcataaattgaatccgaatatcaaatgatcgaataacaagtaatttagattttcatggatatatggaatccccgcttagatggcttcgtgccggaaagcggggattcttgttttattttatctttagtccggggatcaggggcgtgctatctaccagttccaactcttgcaccatctgtaatgttccttgtttgtatttctggaaatggggcgtttggatatggcttttataagcgtcttgatccgcgtaaatctctaggatggttactttatgcggatgttctttctccgatacggcatacagtgtaagaacacccggctctagacgcatggaagcctcgatctcttctttcagaaaggcgttataacgttccaactgggcgggatcgaccgtgatcttggataggcggactaagttcttctcaggggcgggctgagaggactccttaatgatcttcaacgctttgatagcggaagggaagccgatataaggaagacattgtataaccgctgccgttaaggtctccttgctattgccggccagtaagttcccttcgagatgcgagtgtagttggctttcggcttcaagggtcgttagtatgcaataagccagtaactcccgggttttcaggtctagcccgttgcgagtatagatatctccgaagcagaattcggtgaggaatcgctctacttccggacccatatttcccgggacgttcctcatggcctctttgattccctcgccgtaaagccggctttgtatggcttgtcctttctcgtggcgatcttcttccgtaacggtagcttgtctctccagaggcaaagcgatgccttgttgcttaaagacctcgttgatggtatttaaggcattcaatgtcttcgggaaaccgatgaacggggcacatagatatattgcctcccgtagctcgatgggagtgacgcctacgtttagcgccgctttggcgtgggcgttcagttggggcaaggtttgcatcgtggctaatatggtgcaagtgataagctcccgggtctttttatcaagatctcctgtgcggaatacctccccgaagatgaatttctggagaatgtccatcatttccggatctgttccttgtccggtcaatgcctcgcctccgaatagctcggtgtaattctttttacagcgttcgattctgtccatattttgttctgttttagaagttgggatatcttgtgcgaaggctggtatgaagcctagcaggaagagtgcgattgcttttgttttcatgaggatatcgttattgtttgacatcacaaagatattcggatttatctcaagtatatgtatatatattacggatctttgtatcaaaattaccgttcgtaaacggagctgatccggatgacagccggggttgagcaaacgaataaagcgcctgcgattcccttgcgggagactcagacgctttcgttcaaataaatattcttataaagtacgatccggatataaggctttccaccattccggctcgtctttcagccatttggcgaaccatgcgtagatggtattttgccagcctatacgtttctgatagcctacgataccatgattctcgccatccacctgcacgaactccacggttttccctaggatcttcaaggcggcgaacatctggatactttccccgatgggtacgtttgtatcggcgttgccgtgaagcaacaggagcggggtcttgatcttatcggcgttgaacaacgggctttgcttggtaaagaactccggggcgttccaaggataagtgccggcattcgctacggagcaatagccatatccccaataaccttctccccaatagctactcaacgcgctaataccggcatggctgatagcggcggcgaaaatgtccgtacgggtttgtaggtattgtgtcatgaatccgccgtagctggcaccgatgcaaccgatcttcttctcgttcacgaaagaatgctcctcgcagaacagcttggtaccttggatgatctcatcggcggtcttcaggccccatgcgttcacatggcgggcggcgaattcctgtccgaagcccgttgttccactcggattcaaggtgtagaccacgtatccgagagcggcgtacatatgcatggaataacgcatctccagcgcacggttcgtcggggaagtaccgccatagtaataaacgatcatcggatatttcttattcggatcgaaatgaggcggcaggtaataacggccttggatcgtcgtaccgtcatccgacttgaagttccagtcgtgtacctcgcctaaggcgatatcttttaatttatcttgcgagagatcatacaccaagcggttctttccacctttcaggtcgtaagcgtaaaggcggttggcgttggacgcgctctgtccgtaatagaagagaaccggagcgttgtcggccaacgcatacgacatgataatatcctcggaggcggctacttgcttgatcttcccgtttgccgggtcgcacgtatagatccgttggtaatcctcatcctcacagaggatatagatttgcccgttgaagcggttccatacggcatcgatcacgttcggattgaaatccttggtgagaggggaggctttacggcttgccagatcgtataggaataactgcccgtcgtacgagttggagatctgtccttgcttgatatttcgtccgattccgtcgaaagcgtcgcctgccccagctaccaataactgtttaccgtcgggcgagaaggcggcttggtttacgtacggggctttctcccagatcgtatcgatcgccatggtctgcaaatccaatttataaagggagttgcgggagtgcggcaaggaggtgtacacccggtcgctggtgctgaacaatagatagcggctatcagcgctgatatcattgatataagtgtccgtatgcccgaaagtaagttgctcgtacaaacctgtttttaagtcataccgccagataaaggagcggtcacggaaacccgggatacggtctgccggctctaatacacggatcaagtccgtcccttccttgggaccttcctcttctacggtatagagaagcgtggactcatcgggggtgaatacgaaccgccctttcggaaggttcgggactaataccgtttgttggtaggtagacggatctacggttaccaactccgtaccgtccagaccggtgcgggtgtaatacaatcgattgcttttaggcatccatttggcggttgtcaagaaacttccgtcttgcaataagacccgtcccgtagcggcatccatcaattgcccgtacgattcgctcttgccctccgggaatcgattgacgtattttaccaaggcatacttcccgttcggggagacacttacgccttggaaatcctttccttctaggatattcagaagggtgtagcgtttctccgggttcaaggaagctacgactttcgcttccgcctcgctcttgaaggtagcctttaggctgggaggacaagtgtctgtttccgctgtcaggtatttaacgactacttgatagcggcggggttccatcaccaactcggaagaggctccgactggtttatcattgacgaatacttcgaacgccccgggacccgatatatcgagcgtgccttttacgtaccggtcgctgttcaagaagaaagagaatagatgtagggcatatcccttttgcggggcggcgaaggtgatcgcgcctgccgtgtcagcgtcgagtaccgtggcgttcgcaagcgtttgctcgaacggtaaggtcgcttttaatagattctttgcctcgaaaggcttgccgtttacgttgaggctgtccgctaggatcggcttgttgaccgtgaacgggcctgcgtgctggaattgcgttactttcacgtcttccatggcgtaaagcgaaagggcggaaagaagcaatgccggaattaagttagtttttctgttcatatataattagtttaggataaacgttttccgcaaacgatgtaaagctgttcggtatcctctacgacgagcggaagaagataaggctccatcaatgccgccacctctcgggccgggggcaagggcagcgataatcgatcggcgtgccgatggtggtgcgtattgatcttttccttgctctcgctgtggcagataaccaatttaccgccgggcacgagcaagtcgctcatatgctcgatcaaccgttccggccgcatgaaatgcgggtaggcgctatagaggataatatagtcgaatcctttcccctcgtagctcatagcgtcctcttggaggaactcgatgagcggatgatccggatatttcacgcatgctttctcgatcatttggcccgctatatcgatggctacgatttgccggggctcgtacggcagcaggtaactttccaatatccccgtgccgcaaccgacatcgaggatgcgggcgttctgccgcaggttggtacgatccaatatcgtccggatttttcccggatcatgtacgcagacagcgtcccagcgttccgccatcgtatcaaaaaaagtctctatttgattcatgataattgtccttcccatagaaaacaatcgctgaacagggattgttccttgaaatgggttggtttttcgaacaaaccgaacacggacgatccggagccggacatggcggcatataaggcgcctccctcgtataaggtatccttgatccgctcgatcacgggatgtttcgggaatacgctccgctcgaaatcgttcaccatccgctctttccattcggataccggtagccggatgatctctttcaaggaggtctcgggcgtggcgggtgttaccatcgaataggcttcgggggtggagacggctacatccggttttaccaagcatagataataatccttcaaggacaagtccacgggctcgaattggtttcccgtgccggtcgcgaataccggcgtgttacggataaagaacgggcaatcggctccgatggtggacgctatcgcctccaactcatccgggtgaatatccaaaccgcagaaatcattgaccagcttcaacataaaagcggcatcggcggaacctcctccaagcccggcgccaaaaggtatcgctttcaacaaatggatctctagcgggggaatctcgtatctcgtctttagggcgttcagcgcttttatgacgaggttcttctcttgggaagcgtctaccgggattccggtcccggtgaaactgggctgatccgaggcgacgatctcgagggcatccttcacggggatcggatagaagatggtctctatattatgataaccgtccggacgtttgcttaccacgttcagacctaggtttatcttggcattcgggaaacagatcatagtatttaatgtttgttttatatgatacgcgaagataagaagatatccttataaacgttctgttttatcgggtgaactatcggtttccgtggaggccctcaacttgatgcaggcatccaacaccacggtacggttcggtgctgagggcctccgtatcttttccaagacaagctcggcggctacatgccccatctcccggaggggttgctctacggtggtaagctgcggattcacgatcgtggacaggatcgtacccgagaaactggcgatagctacctcttccgggattctcacatgccgctcccttagctcattcatggctcctatggcgagtgtgtccgtgaaggcgaagattgcgtcgaaagagacttgagaggcgaggagataccgggcggcctctttcccgttctcgatcgtaacgcctgtctttatgacgagcgaatcgtcataagggatatggaatttggctaaggcatccttatagcctttggcccgttcggtggcgttgtgtaaataagagggggcttggatatgggcgatccgttttctgccggagcggatcaagtgctcgaccaagaagaaggacttggcgtaatcgtctacccggactttggagacatccagattgcccgggatgcggtcgaagaacaccaacgggatgccttgtcgttggatacgtatgtattcgtcttggttctcggattgatggcaaaggctgatgatgatgccgtctactcggaaacgttccatcaggtgaaggttctcccgctcggtcaacggatcttcgttcgattgtgcgatgattaccttaagcccttccggatataagatctcttgaatgccgtttataacctcggcggcgaaaggcgtggtcatttccggtacgatcaccccaatggtgttcgtacgcccgtacttgaggttcaaggctacggggttgggattgtaaccgagttgtctcgccgtggtaagtaccttctccttcgtttccctgcggatattcttgtcatcgctcaacgctcgcgatacggtcgaagtggagaggcataaggcctcggctatgtctttgatggttatatgtttcatggcacgctctttttacgttgaaacaaaattaataagatgaattggttccggcaagcgaatttgggaacgattgcagattttgggaacgtttgcgggaacgattgcaggtatttttcggagagatacgggagcctgtttctttccggacgtttacatttgcctcaaacaatcctaaaaacagaagaaatcatggagacacaatttagatcgctcaactacaatcgtgaacaagtaaaagcaggtatcgtacatatcggagtcgggaacttccatcgtgcccacgaggagtactatacgaatcagctattggaagatcaaacccaacagtgttggggaatttgcggggtcgctttgttgccgggagacgagcgcttggtaaaggccctgcgcaaacaggacttaatctactcattgacggtttgcggtcgtgacggtaaagacgaggcttatgagatcggatctttgatagaccttatttggggcgtggaagaacctaaggcggttcttgagaaaatagccgataaatccattaagatcattactttgaccataacggaaggaggctataatatggataagactagcggggagtttatcttggataatgagggcgtaagtcatgatctgttccatccctcaacgccgaagactgtatttggctttatcgccgaggggttacgccgccggaagaatctgggcaatggccctgtcacgatcctttcttgcgataatcttcaacataacggcaatacggctaaacgggcgtttacctcttttatcgccgctcaggataaggaattattggaatgggtgtcacggaacgtcactttcccgaacagcatggtggatcgtatcacccccgctacgactcccgctgatatcgagcggctgaatcgtaagaacggtaccgaagacgaggctcccgtctattgcgaggattttatccagtgggtgatcgaggatgatttcattgcgggtcgtccggcatgggaaaaggtgggcgtagaattcacgaaggatgtcaccgcctatgagaacatgaagctgagcctgctgaacgcttctcaccaaatgctctcttatcccgcctttctatctggttaccggaaggtagacgatgccatgcgtgacgggcgtttcagccgttacctgcgcgtctttatggataaggatatcaccccttatgttcccgctcccggcaatacggatttggacgtatataaacgaacgctgatagagcgtttcgggaatcgttccgttagcgatcagttggcccgcctttgtttcgatggcgtctccaagattccggtgtatatgatgccgaacttgatccagatgatccgggagcatgtggacttgactcgtgtggccttttttacggcggcttatcgtcattatttgaaatataaggtagacgatcatgggatgtcgttcgagatcaacgagccttggttgacggcgactgattaccgcttgatcgccagcaacgatgccttggattttctttccttgtctcccttcgccggtacggacttgcgtgcgtcggaagatttcgtggagatttatcaatcgatggtccggagaatacgggaggagggaacgcttcccgtgctggaatcgatactttcataacggggcgtatttgatcttttacctatgaacacacagaaaacaaattctttagggcctttcatcgtcctaatattcatatactttattgtgggtttcttgactactgtcaatgggcagtgtcaaggccccttgaaaatggctttcctgaaagaggccggagagtttaagaatacgtttgtgaccttgatttccttcttctttttcttggggtacctgctaaatggcaccttgggtggtagatggatcaaccgttatggctataagagaactttgatccgggccttgtcgatcatggtggtgggcctgacggtctttttcttctcctcttggtttacggtgaattatgaggcatggaatatctcgattacctcagctcatgtgccttatggctacttcatctttttactgggatcttatctgatgggaacatcggccacgcttttgcaggtggtgatcaatccctatgtagcggcttacgaggtgcggggcacgcaacccgtacaacggatgaatatcgtttgcgcctttaactctttcggcacgacgatcgccccatttttcgttacgagcgtgatgtttggaggggttgctatcgaggagatccatgtggagcaattgatgtttccgttcatcgtcttggcggcttttatcgccttgaccgctttcattacccatcggctctatttgccggatgtgatgaatacgaaagcgaacgagggggaaagattggaacgaagcatttggtcgtttcgccatttgaggctgggggttatcgctatcttcttttatgtgggagcggaggtttccattggggtgaatatcaacttgcatgcgttggaactggaagggacgaatggcatgaacctgaatacgccggccctattggctacgctttattggggaggtttgatggtgggccgtatcgtctcgagcatgttcagcaagatatctccccgggtacaactgacggtggcaacttcgtttgcggcggtttttacgatcgtggctatactggccaataatctttgggtattggtagctgtcgggttgtttcattccgtgatgtggggttgtattttcacgttagccatccaaggcttgaagaaatatacctcgaaggcttccggcgtttttatgatgggcgtgtttggaggagcggtatttcctgtcctgcaaggggcgttggcggatgtcctcggttcgtggcgttggacttggggcatcgtggtagtctgcgaattggttatgctttattatgctcaagtaggctcacgtgtaaaagaggaggattgacgttttgacattctgttatctgaactcccggagaagcgttttttccgggctaaggtacgccttacttccgaaaatgggatagaataatagcatctaattgtcttgtagtgctttatggaaataggccctttcattctagcgagattaattcatcgtatctcatactcttaggtgaaaatagccattttatacgagtgtatcgattgattctataggatgcgagggctgtttcttccttatgtatcgcctaatacatacggttgcgttacctaatgcatacggttgtgttgcctaatacagccttttgtgttacctaactctattacttttgggtctaaacaggggtgtttatgtaaagaaatgagggaaaacgtatgatttcatcataggtttctccctcatttcctctattcgtaaaaaggtcttgacatcgttattctgttattttgatcataatgtcaagattatagtgttttagcttacggtccctatcttattagtctttccaactggctacaatttgtagttgtttcgctactcctctttttcaaacgaactttttgtgtgttccaatgacgatggttttcagtcatcaaaaagacaggcgcggtaaatcaagtttacagcgccttccatttatttagggttatgagctttattaaggctccgcgatcatctctttagcgattatctcggcctcggctttatcggcgtccttttggatgttcggcaattcaaggccgtagcctttgatccggtcctcacgtttcaacatcaaggcgatgaagagggcgagtacaccgaagcaggtgaagactgccatcggtatcgtatagtcgtaagccggtttgcccgtaccattgtctattttgcaatacgtatccaatatccagccgattaataaaggaaccatactcagaccgatattctgtacccagaaaatcaaggcataagccgtgcctaattgcttctccgggataatcttcggaacagatggccacatcgccgatggaaccaaggagaaagcgatacccaatacgatcatcacgattgtcgcgaaccaccactgattcaagatcggaagtgtgaataataaatgcacgccgatcaacatcaaggcaccatagatcatgatcgtcgcccctttacccttgcggtcgtataagttaccgaagaacggagtcagaagaatcgtgccgaaaggtaagatagccgggatgtttcccgccaactccggatctacgttatatttattgaccatcaagtccgtagcgtatttcaagaaggggaatacggccgaatagaataatacgcaaagcagagcgatcaaccagaaacccttattggtaacgatcaataagatatctttcaaacggaaaggctcttcctcctcggcttgctcgatagcgtccatcgaagcgtccagcttgcgatccatcacgcaaaatacgaggaaggcgatcaaaccgatacacaacatacaaagacaaagcaagataggagcggagatactaccgaagtacttggcggcgggaaccgtgatagataaagccaaggccgtacccaaacgagccgtagccatctccaagcccatagccaacgccatctcttttcccttgaaccaccgtacgataatcttagataccgtgataccggcggtctccacgccgacaccgaagatcgcgtatccgagggcggccaccatcacttgcgctttccatccgaaaagctctccttccatcgtaaacgcgtccgagatggcgtaatatttaatggaacaaccgataatcatcaagatacaggaggcgacacccgtgaaacggacacccatcttatccagaacgataccaccaataatcaacatgaaaagaaatacgttgaaccaaccgtaagcgctggtgaaccaaccatattccgtactcgtccagcttagctgttcttccaacatcggtttaagcggagccattacatccgtaaggaagtatccgcaaagcatcgtgaatgccgccaaagcgagtacactccagcgtgcgactttcgagtcgcttagtttctgatgaattttttctatcatgatatttgttttatagagttatattatttgtattcgtcttctttcatgaacaaggggagagcgtccgctacgataaaggtgcttccgccgataaagatcaagtcatccttgccggcactttttaacgctttctcgaccgcctctttcaccgtttcgcaaaggactccgggcagtcccttccgcatggctttcatggcgaaatcctttacgggcatcgctctctccacggaggcttgcgtgaagaaataagaagcatctggtggcatcaaggataatacgccgtcgatatccttgtcgttcaccataccgacgatcatataaatttcgcggaaacggcttctcatggcattcaggtgttccgctatgtgtttccatccacccacgttgtgcccggtgtcgcaaatgacggtcggttttgtccgcaaggtttgccagcggcccatcaaacccgtcagttgggtcacgtgtccgaacccttcatggacggcctcgggcaggatgtcaacgccgcacttctcgcggagcaggtgcagggcggagaacaccgtgatggcgttggcttgttgtacctctccggcaagctcgccgatcacctcgccgtattctacggaggggaacttccagtgtaccatcgacaaccctccggtcccctccagcattcccatgctcaaggcgtagtggaagggtgctcctgcctttctcgcctcgttctggaagaggtcgaaaacggagcgtttctctgcctcccccagaaggacgggtacgcctttcttgataatgccggctttctccgccgctatcttctcctccgtatctcccaagaattgcgtatgatccagactgatattcgtgatgatactcaggatcggggtgatgatgttcgtactgtccaaacgaccgccaagcccgacctcgataaccgcataatctacctgctggttgcggaaatactcaaaagccatgctggacgtcagctcgaagaaagaaggatggagaggctcgaagaaagaacgatgacgctcgacgaaatcgaccacgtaatcttgggagatctttttcccgttcacccggatgcgttcccggaagtccactaagtggggagaggtataaagcccgaccttgaaaccggattgccggagaatggccgccaatagatggctgaccgagcctttgccgtttgtcccggctacatggatggtcttataggctttatggggatttcccagataatcatctagggcgatacttgtaccaagaccgggtttgtaagcggaagctccgctgtgttggaagaccgggatgctggtatatagatagtgtagcgtttcctcgtatgtcatgtttttgtaaattagatgctacaaatgtagttaaatttatttatacctttgcgactcgtttataaaaaggagagaaaaagaaaatggaaacacgacgtataacctatacgcctcaaggaggcgtttgttctaagttgatggtgatcgacgcgaaggaggacgtgatcgagaatgtgcagattgtaggaggttgccacggtaacgggcaaggcatgtgcgccttattgaaaggtatgcgcatcgaagacgctatcggccgtttgtctggcatcgattgtcatggaaggggaacttcatgcccggaccagatggcacaggcattgaagcaattcaatcgatgatcagcttatatccgattccccggatattcaaaatcttgatagactcgtctttcgataacttatgacgtagcttggtgataaagacatgcaggctgcgtgcgttgaagaaagaatcatctccccaaaggtctatcaagatctctttcatcggtaatacttggtccttattgtcgcaaaggcgcttcaatatctcggattcccggttgctgaggagttgtttctctccccggtagaccaatgtctgcgtgatggaatcgaacgtataaagcccgatacggaaagaggtggcttccggtctttggacggacaccttatgcagtaacgccttgatgcgcacgatcaattccgccatgccgaaaggctttttcaggtaatcgttgccgcctgtctcgaagccctctaccacgtcgttggctgcggaacgggctgataggaataggacaggggtgtgcgtatccgtcttacggatcaatttgaccatcgtgaaaccatccatcttgggcatcatgatatccgctacgataatgtccgggttgatctccgcataacgggagaggccctcctcgccattcgccgctagggtgatatcgaactcgttcccatccagcgtatccttgatgatcatggccaatgtaggctcgtcttctactagtagtacttttatcttttccatatttgatacttgattttcggattattatttaaaatgcagggtaaaggtggagcctttgccggggacgctttccacacgggctgttcctccatgtttacccatcatgtcttttacgtaatataatcctaggccataacctttcacgttgtggatattcccgctgggaacccggaagaacttgtcgaatatctgccgctggttggcttcgctgatacccgggccgttatcggttatggagattgtcgtttcgtgatcgtcttgccgggctgtcgcttcgatgcggcaaggttccttgtcggcgtatttgatcgcgttatcaataaggttgctcaacatattatataggtgggtacgatcggccaccaattctatatcctcggggatggagcaagtaaactccacgggtttgttcgctttcagtttgtattgctcgatgagggagttcaccaactcgtttaatgagatggtttcggggcgcaagcggaaggtactgcggttctctacggcgagtgtcaagatttgttccaccaatccggtaagatggataagttggtctttaacgatcgtcaggtatttcttctgtttctcgttgacgggatcgctaaagttcaataatgcgtctacggcggcatagctgacgctgatcggggttttcagctcatgcgtcatattgttggtgaaatcggtcttcaattcttccacggtcttttgctttaagatggtgcggagtaagtatatgaaagcgcaaatgatcagcaaaagtaataggaaggaggagatcaggatgcctttcatctgggtgagtatcacgctggccggcgatttgaggaacaggcgatattgtaacgtgctctcgttatggagcgggtaatcgaaatgcacggggtttttccacgtagtgaatcgttccggcttgtccagatgcatccaacccttctcgtccccgttgtttggcttataaatcgttaccagctcatgttccgttacgatgtttcttgcctccagttccgaggttaataatttgttgtaggtcttgaaatcaattggttttatagaatctatattcgcgtgcatcgcttgctgcaccatgtcctccacctcgccgattacatataggtaatccgttagggtagagtctatcgagctaaagtcctcctcatccccgtaatcgatatgtagtttcatgtgtgagtcgggatttgccgtcttgaagatatcttcccggttaaggtcaggatcttctttctgcggatggatcgaagcttttgcgtccatcttctgcttattagacggatctagctctgagctgaagtacacatcttgggtttgaggtcccagcgctccctgttcttttttgatagatcggatgcgcaggaacaactccttatagtcggcgatcttcatcgcttcctctatattgatctccatctgtttatataatgtatcatataaacctttcagccagtatccttggaaaaccaaaagcccggccagcgataggacgatcaacaaagcgattaacttaaaacgaagtctgatgttcatgaagtctctttatgcttataatcgaattgatcgctaaaaatagacaattttattacatgaacttttaatacgcaagataaactttatgcgggcgcttgtaaatatttactaaggatgcccatcaacgccccaatatcaatcggtttagccaaatgataattcatgcccgctttgatagcgtttgtcacgtcttcggaaaaagcgttggcggtcatggctataattggcatgtgtgcgatatcccttcgttggagggaacgaatctgccgggtcgcctcataaccgtccatgataggcatctggatatccatcagtattatctggtaaaatccttcttccgattgggcgactttatgtacggcgtcgagcccatttatcgccgtatcgatagtgataccggtgctgccgatgatctctacggcgatctcacgatttaactcgttatcctccaccagcaagatgcgcttgccggaataatcgacgtttgataacttgaatgggcggatcggttccggctggtctccttcgtcaaggaaagatctcaatacttggagtagcttggacttatagagaggcttggtgatgaatccattggccttaacctccttagcctctgcctcatattcctcaagatcgtatgcggagagaatgatgatcggtacgtccgctcccacgaaacgtctgatttgccgggttgtttcaatgccgttcatttgaggcatcttcaagtcaatgatcacggcgaaatactctttctccgctaaatgatgctgtcgtactttttctatagcttcgctacctgaatatacgcattcactgtttatcccgatctctcgcaaacagctagacgtgtttagacaagcgatcttatcatcatctaccacaagaacctctaaaccttctacctctatcttatcatcgggcttctgatcccgacaaaccaatggcatgtcgatggtgaagcgggaacctttgccatattcactctccaccttgatatctcctcccatcatctgaatgatcttatggctgatcgacatcccgaggccagtgccttgtatcctcttgatctcatcatcgctcgcacgctcgaaaggctcgaaaatcttatccagaaactccggtttcatacctcttccgttatcctcaaacacgaattgataatttccgatgccattatggggggccttctcgtagatctctatcgtgattcgcccattctccggcgtatacttaattgcgttcgagaggatattcatcaatacctgcttgatacgctgcgtatcaccttttacattctcatgcctcaggttcttgacgtgtatatttaaagtttgttgtttgtttttgatctccggttgcatcataacgaccaagtcttgcaagagctcacccacattgaactcatcctccgaaagaattaacctgccactctcgatcttggacatatcgagaacctcattaatcagactcaataataatttagaggctccattgattttttccatacaatctagtattctttcatgttcatctacatgggctttggctatagtcgccattcccatgatggcgttcatgggtgtgcggatatcgtgactcatgcgggcgagaaaatcagatttggcttggttggcttgttccgccgactttagtgcttctttaagttgctttgactgtttctccagtttcttttgcaactccctctgttcggtaatgtcggtgatattgatgtaaacgataagatagataggctcgtcgccttcccagccgatacattccccgttcaactgtagccaagcgccgttgccgtttttgtctttcgactggataacgaaatgtacaggttccccttttagcatacaggggatatgtgcgttcatcgtattacggcttgtttcatctaaacgggagaaaggactgaaagataaaaaagaatttttatcgataccagagaagtccatatatttatcatttgcctccagcaatgtaaaactgccgtctttatgtactttatgcttggatatgaagccggggatattatcataagtgatcgtttgctcgatccgccttcgcattacgtcctctacatcggtcattaccgtataggagatagggatgccgtcttgtagttggtcggtaaacgttgaggtgattttagtccatctttttccttttctcgttggcatctggataacggtttcgtaaccgctggctttattagctatcgtctcgtaaacattcttggataatatattccaagcttcatcataacctttaaaatacaaatcgggtttattgtggaaaagagcttcatattcttctttggggtaacctatcatatcgtaatagaagtcatttgcccataaaagtgtaaaatgctcatccaataaatgtttgctaacgctagctcccgtaagccccatcaataagttgtattctagatccgtctctcgcccttccatcgtatgtctttttatattatcctacaaaagtaaaaattataaaaggtacccttgaaattcttctttttgataatatgttccgtttttgctttcggctagtcggatgttttctggtaacaagaataggtatacgatttacccctgtattcttgtggagtcatgcctacatttcgacggaagaacttattaaagaacgatagattattaaagccgaggtccatcgctatgttcttgatttctcggttggtccctttcaactgagccttagcgtctatgattattgtttgcgtgaggatctcttgaggagtctctccgatcgcttttttgatggatgtcgagaaataagagaacgtgaggcccaacttctcggcataaaacgatacgttgtgctctttcgtatagtatctcaataccatatttaggaactcttgatagatttgtaacggacgtgtaagttcctgtttctctaatgggtaatttttactgtatatttctatgataccttgactacacatcatgaaaatggcctttatcatctctttattgttcaagatatcgggatatacggcatattgatagagaagctcgtagaagttcgtgatcaggttggccctgttttgggatatttttataatcggatacctgtaaatcatcagtagataacccatcgtgctcttgataaaattggtgtaacacataaaatcgaaagagaacgctatgaaatagatcaagatgtcgggggatatctcatgtatttgtatgcgactattgggcaatagcgttacaacattgagtttcgaagtggtcaattctgacatattgatagttgagcgtatttgcccttccatgcaaaggataaagaccccggcttttatcttacaaggaatatttataaactccttgagttcatcggcggatatgtatttaccaaccataaagtccgtaggtgaatcaaggcagaggaactgtttatccatattgtaagatttttgacgtcaaatataaatattaattgaaactcaaatgttgtaaaaggaaatatggaacatattatcccaaaaaatagttagccaagactaaataagatcctttacacccataaacttgaacggttgcgccggcttaaagtcttgtgcgaccagtcgctaccatcccgtttgttcccgaataaactactcttgtacacatgattttcaacttttaataggttatcttcaaatatttgattgatatatcaacagttagaacctcttaatgttcagtttacgtttttgcgtcaaagagtgcggcggcctcgaaacctttttcctgcaattcccttaggtgagatttagcacaaaggataccactcatactacttttccgaaggtgttttctagattaccttgttcctctttgttgggtttgataattggcgataagactaaataacattcctgataagacaaggtaagacttcgtaagtgagtggtaacatagtttcttttaagaatacgtttcttttgtatgaacgaaaaatgataaaaacaaaccgatatgaaacgtactatttactacatgattttatgcttgctgatgagtctcggtgagattatggcacaaggtatttccgggaaggtgatggatggcaaggaacagccggtagatggagtggcggtgattttacagaccctcgactctgtatatgtggatgccgtggttaccgatacgcttggggattttcgattgaatcatccgctagaccagtcgtatcgacttattttccaacacatcttatataatatggtagagaaagagataactaccgccaacgtaggtacggtggtgctggaggagaaagattatcagttggccgagattaccgtaaagggagaacgcccgcaagtgaaactggagggaggcaagctgacgtatgatgtccctcaactgatgaaggataagactgccacgaacgcttttgagatcatcaaggacttaccggggcttatcgagcggaatgataatctggagctggtaggggccagtcgtttgaatataatcttgaatgggcagttgacgacaatgtcggcagatcaattaatccagttactgaaaactatgccggcctcaagggtcgaaaaggctgaggtgatgtataacgctccagctaaatataatgtcaagggggcgttactcaatgtcgtattgagtaagaatgagtccgagactccttcttggcaaggtgaaacgggtgtggattacacccaatatcgccatgcggggggagatgcgcatgtgaatttactttatacgaataagggctttagcatagatttcctgttgaatggtaataagagacgggatgtgatgggggaggatatgttggcccgccatacattaaatagtggtatgacggaaataagccaacataatcgggcccttgtccatgtaaatagaggaacggttcgtctgggaatggattatacgtttgcgaatgaggataaactctctttggcatattatctgaagggagataaagtcttatcggaccgtgatgcctttacctcatatctggatctgtcgaagccggaaaataaaagtgagagtacgagcttggtccgtgatgacgggcactccgctattcataatatacgtttacagtatgacggacatgccgggatatcggcaggagcggatttcacccgttatcattcgccctcggtacttgattaccaggatacgaatacgaatggttcccggactgatatgataaataatacgagacaggatgtatcccgctggtccgtattcctaaataagacacatagtttcgcttccgggtggggattgaattacggcgtgcatggaggttacgcttcgtcgaaaaactattcggagtatttatatgatcaaggtgctggctatgagatggacgaggaagcgttggaggataatacacaaaaggaatacatcgctgatattttcgccgaggtatcgaaaagcttcggagagtgtttctctgctacggtcgggctgaaaggggagtattttaagtctgactacgcctctagccgggaaaatatgaacctatggaatgagggggcgttgtttcccaccgtatccctgagctatacgttttctccccgacatattttacagttcgatataagtagcgataagacctatcccggttattggcaagtctccccgcaagtaacgcctctaaactcttactcggaggtggcgggaaatcccttgttgaaaccttatcgcacgtatgaggggcagatggtctatatcttccgccaaaagtatatgctggtagcgttctgtgaatacacgccggattatttcgcccaacttctttatcaaagcgatacggaactgaagaccgtttttcgtttcgagaatatggattatagtctggaagcgggattggcggtgatcattccttttaatgtgggtcgtttttggaatagccgcatcacactgcgaggttggaggatgcaagagaagaatgataacttccacggcatctcatataaccgtgaggcttatctcgggttagcgcatatgagtaacacatttaacctatgtgataaaccgaatttaaaaatgacgatagacggccaatacgtgactcccggtgccatccaaggtatatacgacttgggttccatgtatgagatatccgctggattaaaatggactttcttgaatgaccgtgccagcttgacacttaaaggagacgatattttcgccagcagcattccacgtaccatcaagataaaccaaggcaatcaatggagccggatgaggaaattgaatgatgagagatgtctgaaattatcttttgtctggaagtttggtggttacaaggagagggaacatgattcgatagacacatctcgtttcggaaaataatagataccttgtagtttcatcctaatgaactctttgtttcaataggatgaaactggatgctcttctaaaggaaatcctatattgctttcgtactcgcttctatctgttccattagcagggtgatattgctcatgaatagcttgacggagatcgccagcaggatgataccgaagaatttacggatcaggtatatgccgcctttccccaagactttctctaccttgcgtgtcatgcggacaacaaagtagacccatagcatattcagtaccaaggctacgataatattcacgctggcatattccgcacggagcgataataaagtggtgaacgatcccgctccggctagcaacgggaatactagcggcaccaacgtagcttccttgatcggcccttggttcttgaaaatctctatgtcgagaatcatctccaaagataggaggaagatcacaaaagcgccggccacggcaaacgactcgatgtccacatggaaaagcctgagtaatatatccccggcgtagaagaaccctaataacaatagaaaggagattagggttgccttcaacgcattgacatccttgcctttatcctttaggtttatgatgatgggaatagctccgattatatcgataacagcgaataatacgatgaatgcgctaagtatttgttggaaattgaaatttgtgaacatgacgttatcctcctctattttttaatcctcgtaaagatacatatttttccttgaattggtcaatatgacgaaattattggtgtgtgtaactaattttagcaggcctgaactatcaacgtgtcagaattgttcttatattagaagcaataatcattaaatcgaaaggccatgggagcaaagaagaattttgtgttggacacgaatgtcatattacatgactataagtgcatcgagaactttcaggaaaatgatatctatctacccatcgtggtattagaagagttggacaagttcaagaaggggagtgagcagatcaattataatgcccgtgagtttgttcgggagctagacttattgaccagtaatgacctgttcttaaaaggtgcctcacttggaccgggaaaaggtacactctatatcgtgaccggtgataagtaccaggagaaaatagcgcattcttttccggataaaacaccagatcaccgtatcttgtcttgtgcgttgacaatagccgagaagaatccgaagatcaagacaaccttggtcagcaaggatgtgaaccttcgtatgaaggctcgttctttgggtattcccgttgaggattatatcacggataaggtcgtgaatgtagatattttcgagcgtgcgcaagagacctatgagaatatagaccccgatttgatcgacaagatatacagctctccggaaggtgtggatgcagattcgttggatatcaagtctaagctcgaccccaatgaatgctttatcttgaaaagcgtacgtaatagtgtattggctcgctacaatccgtttacggataagatcaagaaggtggataaaggcacgaactttggtatccagccccgtaatgccgagcagagtttcgctttcgaggtattgaacgatccgaatatcaagcttgtggggctgaccggaaaggccggaaccggaaagacattgttggcgttggcctctgccttgaaacaagccggcacgtataaacagatacttttggcccgtccgatcgtcgctttggcgaataaggatcttggtttccttccgggtgacgagaagcaaaaggtcgctccttatatgcaacctttattcgataacttgaacgtgatcaagacccagtttgccccgggtaatcccgatgtccgtaagatcgacgatatgcagaagaacaaccagttggtgatcgaggcgttggcctttattcgaggtcgtagcttgtccgagacttattgtatcatcgatgaggcccagaacctcacgccgcatgagatcaagacgattatcacccgtgcgggagagggaacgaagatggtcttcacgggagatatccaacagattgactccccatatctagacgcccaaagtaatggcttggcctatatgatcgacaagatgaaaggacaggacttgttcgcccatatcaacttgataaaaggcgagcgaagcgagttatctgagttagcgtcagatcttttgtaattaatatagggaattgaagattgaaaataaacgcttatgtgaagcttgatttttaatcttcaattcttaatgattagtcatttacgctcgggcagacataaatcttccggaaactacctttataggaaggggctcccatatctttgatctcattcagatgttgtttaagatgggcggtttcgccgtgcttttgtaattccccgtcgtttttccaagtctcggcgataaagaattcggtgctatcggtgagggattggtacatgccgtagtcgatacatcccggttctagcaacgtgctttccttgcatttcaagaatgattcctttaaggcggagacacattcgggttttactttccgtttgatattcagtacgacttccatggactctttattgcttcctccattcgtacaaccggatagagcgattaatacgcaggccattgagataaacactttcttcatgatagattgtttttaagtatttgatacgacaaaagtagtgaatttttgatctaaacacaggaatcgaacatctgatattaaattattgttgttagtggaagttggaatggatatatttgtgataatattaatagctatttatgttaaatttaaaacaagagtcatgagaaagagtttgttgtatgtatttgccgtgatttgcacgatgggtttttttacggcatgtggtgatgatgacgattcaagttcttccggtaactggcaagatctgtcgaaaacgtacgagggtaagagcgttaatctggtaatgggtgaagtgacaatccctgttgacggtaaatcggtcgtgattgccgcttcctctgcggagaaggcatccgtaaccttgaacaatatcatccccgaaaataagtcggtcgctatcgatgccgcgttgaaggaagcggatggcacttatacgtttaccggcgagagtacggttggcgattgcgtggtatcagtaaatggtacggtgaaagagggcgtagcttctgttgtttatactcgtaaattaacttcttctatcgtaggtaattggagcttgaaagcgggcgtggaagctatctatgcgaatatcgttaccggaaattctacgatcgatgatctcgtgcgtatgataaagccagctatcagtaacttgatttggggcaaagtaagcgctgtaaatgttaacttaccggaagatggaatcttcgatgtttcttggagacctatgggggcttctgaggataaaggaatcggtgagatcacaaaaatggcaagtatccaatattgtgtggtagacgggaaatttatggtggctgtggataaaaattatgtgacagtcttgactactttattacaacaggctgctggtgacaaattggaggccgctggtatctctattgacgagatcatgaagcttttggttgatttaggaggttattatggtctacctcttaacatgaaggtggatggaagtgaggctactttttatgcggataaggatttaatcgtaccggttttgaccatgatagctcctatcttgaaaccgatggttccggagaattatcagcaaatggtagatatggtattgcaactacttccgaacgcaaaaacgttagagtttggacttaatttcacgaaataattgaaaatcctaggttgtagagacggagtacacccgtctctacaactggatgaaatttggcagagttataccaatataggagttaatcaattaccttggtgctttctgatataagaatatcgctataaatgtataaactatattcggtatccaagctgctacggcaggactcacataaccattaatagcgaaggtggaagtaaccgtcataaacaggatgtaagaaaaactcaacgccaatccgataccaatattcatacccatacctccctttattttccgggaagacaacgacgctccgatagaagtcaagataaacgccgccatgatcgtggcgaagcgcttatgatactcgatctggaaggtctgtatattcccgatacctctttttttctgccggttgatatacgtattcagctcgggcgttgtcatcgtctcgcaatcattcacggaaatcaggaagtccgagggcacgatggtcaaggtcgtatccttacgggagccttcggtgatatgttcccgcatgccatcaaaatcacggatcatataatcgataacggtccattgataaagcgagtcgtatttgattgacttggcggtcagacgggagatcaatttcttatcctcgaaatgctccagagagaaacggtatcccatgttcgagcgagcgtcatagctatcgaaataagcgataatacccggctcgatctccaattgggcgttctttacgtagtccaccttcttgttgcggatatacttgttctggaaatcgatacgagtctcattcgccgggggaatgatgtaagcgttcaggataaacgtcacgatagcgataatcgtagccgagaccgcgtaaggaagcattaacctacggaaactcataccgctggcaagcatcgctatgatctccgaacgatccgctagcttcgacgtgaagaagatcacggcgataaatgtgaacaacggactgaacaaattggcgaagtaggggataaagttcaagtaataatccacgatgatcgccttcaaggggacatccggattcaagaacttatcgatcttctcgtttatatcgaaaacgacggagatagagataatcaaggcgatagcgaacacgtacgtgcccagaaactgcttgatgatataccaatcgatccgttttagtttaaatttcatctgtctcgttttttataaccggttcgctaattgacggaccataccacttttccatgtagtaaaatcgccagcgatgatatgtgccctcgcttctttcaccaaccataggtagaaagcgaggttatggatagaagcgatctgtaagccaagcatttctttcgccttgatcaagtggtgcagataagccttgctatataaggtatccacgtaggaatgtccgtccggatcgactggcgagaaatcgttctcccatttcttgttacgcatattgatagtaccgaagcgggtgaagagttggccgttgcgtccgttacgggtcggcatgatgcagtcgaacatatcgatgcctcgttcgatcccttccagcagattgatcggggttcctacgcccatcaagtaacgaggcttatctttcggcaagatctcgttcacgacctcgatcatctcgtacatcttatcggtaggctcaccaacggccaatcccccgatagcgtttccatcggcgccttttcgggccacgttctccgccgccctctgccgcaagtccgtatagacgcatccctgtacgatcgggaagagactttgccggtagccgtatttcggctccgtgctgttgaagcgggcgaaacaacgatccagccaacgctcggtcaggcccagtgattgcttggcgtaattgtagtcggcatctcccgggcaacactcatcgaaggccatgatgatatccgcaccgatagagcgttcgatatccatcaccttctccggcgtgaacatatgcttggagccgtcgagatgcgagcggaactcggctccctcttcatgcagcttacgattgtcggaaagggagaatacctgaaaccccccgctatcggtcaatatcgggcgatcccatgtattaaacttatgcaagcctccggcctgctccaagatctggataccgggacgaagatacagatggtacgtattccccaagatgatttgtgctttggtatcttcctttagctcggtcatatgtacaccctttaccgtaccttgcgtacccacgggcataaaaataggcgtctcgattaccccgtgatcggtggtaatcaagcccgccctagcgttcgatttcgtatcgttatactgtaattcaaatgtcatgtatcaaaaatttgtgacaaaggtagcatttttctcttagaatccgaagtcatctatttctacctttttcacctcttcctctttgggcttctccacgaacttgtgaacctcgttcgccttaatgatgatcgctctcatcgggcgtacgggacagatcgattcgcagccgccacaaccgatgcaaagatccgggtttacttgcgggatggtaagcgtgccctcgtaaggaaccatatgcacggcttgggtagggcagtgctccgagcaggccccgcagtccgtcccctccgtctttacgatacagcggttgatgaagaaggtggcgatgcccacttgcgtagtagctttctcttccttagtaagcggttttatagcgtgcgtggggcaaacctccgagcagaccgtgcattcgtagttgcaataactgtcgatgtaagcgatacggggtttcaacatataatcaaagccgtactccagtcccgtgggacgtagtacatgactcgggcattgagtcacgcaaatctggcatccggtacatacatccttgaaacgctctaagctgatcgctcccggcggtacgatagggggccatttcttgccgtgcttaccttgcccgtgctgccctttgccatgccctttttccattccttgggcaatggtggatacgatcgggagggaggccgcggcggtagcccctgccgagagaaatgtacggcggctgttcggagcggtagcctgttggatcacgtccgtttgtatgcgagctgtttcggcttctttcttgaaggaaggcttgaaacgatattgcaatcctcctttagcgcacgaggacacgcagttgaagcaatttacgcaacgggaggtatctacggtgaggttcttgctgtcgatcgcctccgccttacaagtatgctcgcaattaccacaatgcgtacaggcttctttgtcaaaggagatccggaaaaacgaataccgggagatcaggctcaacagcgttcctaccgggcaaagcgtattgcagaacaaccttccccggaatacgaccatgatgatgaatacgagtagcgcaaccaaagcggatatcacgccgaataccgtcacgttgctaatcgtgacgtgataaagcgtatagttatccatccgtgccaatccgtcggccagcaggttattgacccacatgacgaccggacggaacaggttgttcgctatacggccgaagttactgtacggatctagcaacgtacataattcgatcatcccgaaaacagccagtacgaatgtaagcccgagaatagagtaccgtaagatattcatgggcttatgatagctgaacctgcgtactcctttctttttcttctttccgatacagaaaacccggttgataatatcttgcaatacgcccgccgggcaaataaccgagcaatagatccggccgaacaataaagccaatacgaattggaagactaccaaccccgccattccccctaaaatagcgggcatgatctggagatgcaacaacgtgtgcaggttgtccggcaatacatcggcgaaatcaacgaagaataaaagtatgggtacgaaaatgaggatcgcgagtacgacccgcaatccttttaagtaattaggcttcttcatcctcgattatatcttaatacgtttgatcgtgacattatccagattcgttgtacccagctttaaagcctcgcctttaccgatatgacctacggtggccatatccagcttcttcacttggttgaacaggcgaagggcggcggtgtctatagcgacgatattggtggaggcgatcaaggatttcaaggtagccacatcggccgcgctctttccttgcgggccgttttggtgcatgatgcgataagcgtccacgatgttcaataccggtttcttttgccaagtgcaaatatcggcgatacattgttgcaaatcattttgatggaagaaacggcgatcccatacgattcccatatagttcttcatggcgcaagtcatcttcgccccaccatggttcttcaatacggggacgttgatccatgcgtccgcctcgatcagggcctcatggatcttggcgcttttcaggttcacgccacccggaatggatacttccttaaaatatttctcatcgttggcaggcatgatgatacctccggcctcttttacggcctcggcgatcccgctcgtctcatagcatttctgccagttatcgcaggtgtggtcgaatacggtcactttagaggcgccggcctccaagcatttcttgaccaaggctttcactaatttggggttcgtattaccggccaattcaggagagcggtcccaaccgatattcggcttgattacgatcttttgtcctttctttacgaagtttccgataccgccaagggcttccaaggctttatctagcatcacctccggctctccacccataacggctaccatatcgggagccttctctacggctacggtgttcgtggaaagggccgcttgcagaccttcaaaatttaaggatagagccgcgctagcgatgacactggtctttaaaaaatcacgacgtttcataattgtatactatattggtttatacttgatttacggtacggtctttttttactcgcttgttattccgaacaaagataatgattattttgatatgcgagtcaactccttttacaaagtagaactgctttttactgcaacccgggttgcagtgatcttgcgtaataagataaattcttgtcggaaggcatatcggttctgataatatttttctaccttgcgaggcaaaaaacagattgtatggttttatattgtagagtatcattgaacgcttttgtcgaaagctttcggactacctcggggcctgattcctttttcacgcttccggcgaaggggttgatgcatatcgtgccgcaagaggagatcgagtatgggctttccttgcttagggagtctatcggcttgtatgaggaacgcaaagggatacctgtggaaaagagcaagaaagcgatgccctttttcagacaggacagccggatgctggtggggccggagataggcatgtacgtgatccctttgtatgaggaacccggtgagccggcccagtctgccgagccttctctggtccttgagctggactatcagtcgttgggcgagctttgcctgttcgagaattattccctgttgtcctgcaagtatgagaaggagcctatcttgaaccattttacggcacaattggaaaaggaatacgataccttcttttttgatgaggagcacacgggctttacgcctgattcccgctttttctcgatgctgtgtaacgcctgtctggaggtgaagcagccttcctcggtgggggataaggaatggcggttggcctcgctgcaagctacggatgaggtgctctatcgttatgagcatggaaacttgatcccatacgttccgatatcgatgccggtagactgcctgaaacgggtttatctggaagatttccggcgacagcccttattattcgggactttgaacggtttcttgaaaagcaagggacttcccgccgaacaattactaaacttatcataaggaatgaagacagtatcaaatcaagaactaacgatccgtgtctccgaacatggagcggagttgagtagtatcgtagcgaacgctacgggaaaggagtatctctggcaagcggaccccgctttctggaaacgtcattccccggtattgttcccgatcgtcgggagcgtatggaaggccgagtatcggaacgagggaaccgtgtatccgctgtcgcagcacggctttgcacgggatatggattttacgttgatcgatgaggcggagaacgagttgcgtttcgcgctggaaagtaccccggacacgctgagagcctatccgttccctttccttctggagatcgggtatcgtttggagggcaataaggtggaggtgctttggcgtgtgaagaatacgggagataagacgatgcatttccagatcggcgctcatccggctttcctgtacccgaattatgaggtggatcaaccggatcgagggtatttcgctttcgatgtgaaaaaagatctcgtataccgtgcgctggtggagaaagggtgcgtaggggacgtggttcgtccggtacctttggatgcggacggcttgctgccgttgaatatccatacgttcgatatcgatacgtttatcttggaggacagccagattaagcgggtggacttattggatgtggagaaacgtccgtacctttcgctcacctttacggctccggtggtaggcttatggtctccgcctacgaaaaacgctccgtttgtctgtatcgaaccttggtatgggcgttgcgaccgggtggattatacgggtgagtataaagaccgggattgggcatggcatttggaaccgggagaggtcttcgatgcctcctatacgatagagatagcgggggcttgatcgcttcgttgatattagccgtaggcagacgacgctgattatatcgtgatcgtctgcctatgttttgttttagatgttggctattttatttaatagctccatcttcccgaataagatcagtagatcatcagcctcgatcaccaattcctcgctgatgcggctgataaccttgtattctgtttgtgtgagtccgatcaggttctttttctcgtaaggacgttcgatcgctaccagatggatgccgaaattctcctcgaaatcaatatttttgatcgtttgcccgacaagagtggccggtgtcttgatcttatagagatgttccgtatcggttactttataccaatgcctgaacaggccgcctaaagacgcttgggaggtatacatcgtagagaaatcctcttccggtgtgataatctcgcttaccccgatcgcacggatcacagtctcatggattgatgagatcgcccgcacgatcagtttgcccgcatccagactcttcaataaagcgacggtctgaacggaagtcccgaaatccttaccgaatgttacgataatggcatccatctcgctcaatggcagggtgctcaatgcctctttgtccgtggagtccaaggcgatcgcccccgctatgtcgttctttagcatatcgacacgatgcagatccatgtctacgccgatcacctcattgccgacacgtgtcaagtccttcgctatcgcacgtcctaaattccctaatccgattactaaatatttcatgctatcttatttttacattaatatattttcttgtggatatgtatagtcctttttcgtgtattccttgcagaaacttacgaggaaggccaataccccgatacgtccgaccagcatcgtgctgataatgatgattttcccgataggggtgaggtgaggggtataatcgatactcaagcctacggtactcaaggcggaaacaacctcgaacaatagggagaacagcggcgcccctttttccgtataggataatacccacgtagcgatcgccacccacatgaagtacatcatgatgatagcgaatgcccggcggatagcgaatggggcgatctcccgttttctcacttccactttatctttctcacgtgcggcgttcaaggtcgtaaccagagctacgaaaacggtggtcactttcaagccgccgccggtggacataggggcggctccgattaccataaggatcaacgtcagcattaaggtcggaggggccaatgtagccatatccgctacgttgaatcctgccgttctaggcgtgacggcgcctaagaacgcatttgccagtttcccccgcaggggaaggtcgcccaaggtattgtcatactcgaaaaagaggtagaaagccgttccggtaattaacaggatcaaggtagatataacaacaatgtacgtatgtacattaataatacggggcgtatggatataatgcttttgcttaccgatcaatatcttgataccattcatcagcaagtgatgcaagagtttcaggtaattgaagacgatcgggaagcccaagcctccgaatataatcagcatggctatccagaaatggaggttgtacttatccgccactaacggatcgtacatattgccgctcaaggtagagatccctgcgttacaaaaagcggacacggcatgaaacattgcgtagaataattcctgctgcgtacctcccggcaggcttccccgtacgtccatataaataaaataggcgccgatcccctcgataaacaaggtcacgaaaagaatgtttaagatgacccggaacaaccctcccgtccgatcctcgttcaacatatctttcagcatcatcttgctcgtaaaagaggatttccccatgaaggagagggcgaagaaagaggtaaatgtcatgaccccgataccgccgatctgtattaaaatcatgatgataatatgcccgatatgcgtgaaactagtggctacgtcgacggtggttagtccggttacgcataccgaggtcgtggagataaacaaagcgtcgataaacggaatccggtgcgtagtggcgttcggcaacgatagcaacccggccccgaccaatatcacgaacacgaaactgagcaagaaaagcaacgagggcttgatccgtgtctgcatcagcgtgaacgtctgccgggataagtgaatcgtgctaagcagcaataataagacatatacgaagagaggtttcgtaaggaaagacaaataaggcaaagagtgcgctatggcatccttgaaaaatatcttgctggataatacggcgaataaaaggaaatagatgctgatatcgagatacaacattttctcctgtatgatttcttggaacctcaccacgtaccggagtgttatgcccgtgaaaaaagctagcaggatgaatgggcgggagcgctctaggatatggacggaatcgggtgtctgtacaaagccgaattggtagatcaatacgaagaaagaggctaaggaggcgagtaggataatcgcttccgctatcccgttcaataatcccttcattttaccccaataaatcagccaagagaagtatatgttttttagattcatgtccgatgttttataaatataacaaatgtaggaaataaaagttagaggtacgtgaaagcgccttcattatttgttctcatactaattgttttacttacattatgtgttgtatagcatattgtatgatgtacgatactgaaatatcagaaaaataatcaattaggaggtgcaaaaaagaccttttgtaattgctttgtttagaaaaatacttatatttgcgcaaatctaattactgatatcatggatgcacaaaacgagaatagagagatgctttccccctatgtttccgtagactgcgttcttctcggcatcaatgatgacaagctcaccgtgctgttggcggagcggaaaagtgaggaaggcgagttgatcggctataaattacccggcagcctgatctatgagaacgaggatttagatgacgccgcctatcggatactgaatgattcgaccggcttgaagcgtgtccaattgaaacaattccgttgtttcggttctcccgcccgtacctcgaaccggttggacgtgatgtggctggaggcgacttccaaggtgaagatcggacggttgatcacggtcgcttatctcgccttgtgcaagaatagcaggaagacgtgtccggccgataaatccgactcgatccgttggtgccctatcgacgatcttcctcgcttgccattcgatcataaagagattatcgaggctgccatacaggagatccgtaattgggtagagaaggaacccgccatcattttcgactatatgccgatgaagttcacggcgttccagctcaggcgcacgtacgaggtgatctataaccgtgagatggacgtgcgtaattttcataagaagatgaattccttggattacgtggtacccacggaggatatgcaagatggggtcgcccatcgtgccgcccggtattatcggtttgataaggtgaaatataatcaacaacgttcgaagtttaataagatataaaaccatacgattatgtgtttgttaggatgtgatattggaagttcttccatcaaggtctctatcgtcgatgaggagaccgggttaacaataggtgcggatttttatcccaaagaagaggccccgatcaaggcgttgcgtccggggtgggcggagcaaaatccggaggattggtggtcgtacgtgaagatcgctatgaaaggtgccatgagcaaggcgaaggtgaaaggcgaggatatcaaggcgatcggtatctcgtaccagatgcatggcttggtggtggtggacaagaagatggaggtgcttcgtccatctattatctggtgcgatagccgtgctgttccttatggcgagcgtgcgtttaagaatataggcgagaagcgatgcctttcccacctattgaactcgccgggtaattttaccgcttctaagctggcttggatcaaggagtacgagccggatatctacgaccgtatccataagatcatgttgccgggagatttcatcgctatgcgcctgacgggggatatcgtgactacggtttccggtttgtcggaggggattttctgggacttcaagaataatgccttatcggaggatttgatgaattattatggattcagtaaggatctgattgccgatatccgtccgacgttcggtttgcagggcgaggttaccgcctcggtcgcggccgagttgggactgaagaaaggtacgccggttacctatcgtgcgggcgaccaaccgaataacgcattatcattgaatgtattgaatccgggcgagatagcggctaccggcgggacttccggagtggtgtatggtgtgaacggcaaggtgaattacgatacgctttcccgtgtgaatacgttcgcccacgtgaaccatacgacggagcagacccgcttgggtgtcttgttgtgcatcaacggggtcggtatccttaattcttggatcaaacggaatatagcgccggaaggtatcaactataatgagttgaatgatttggcggctacggttcctatcggctgcgacggcctttcgatcttgccgttcggaaacggggcggagcgtatgttgcagaataagcagatcgattgctcggttcatggattgaacttcaacatacataccaaggcccatatggctagggcggcgcaagaaggtatcgtgttcgcctttaaatacggtatggatatcatgaatgagatggggatcgatattcaggtaatccgtgcggggaacgcgaacttgttcttaagcccgatcttccgggatgccttggcgggcgtgacgggtacggtgatcgaactgtatgatacgaatggtgcggtaggcgcggccaagggggccggtattggcgccggtatctacaagaacgcagaagaagcgttcgcttccttgaagaagatcaacgtgatcgagccggacggtttcaaggcgaatgcttattgcggggcgttcgagacgtggaaagaacgcttggaacaatctatttaacggctgaattatttacatttttaatatatattattatgagttactttaaaggagagaaagaatttttcccgggaatcggacagattcagtttgagggacgtgagtcaaaaaatccgttggcatttcattattatgacgcggataaggtagttatgggtaaaacactaaaggatcatttgcgcttcgctatggcttattggcataccttatgtgctgagggaggtgatcagtttggtggtggaacaaaatcattcccttggaacgacagcacggacgctatcacccgtgcgaagtacaagatggacgccgctttcgagtttatgaccaaatgtaatattccttactattgcttccacgacgtggacgtggtggacgaggctcctacgctgggcgagttcgagaaacgtttgcagacgatggtggaacatgccaaggagcatcaagccgctaccggaaagaagcttctatggtctactgcgaacgtcttcagcaataagcgttatatgaacggcgccgctacgaacccttatttcccgaccgtggcatgcgctggcacgcagatcaagaacgctatcgacgcttgtatcgccttagggggcgagaactatgtattctggggcggtcgtgagggttatatgagcctattgaacacgaacatgaaacgtgagaaggatcatttggctatgatgttgacgatggcccgtgattatggtcgtaagaacggtttcaagggtacgttcctgatcgagccgaaaccgatggaaccgacgaaacatcaatatgacgtggattcggagaccgtgatcggctttcttcgccattatggactggacaaggatttcgccttgaatatcgaggtgaaccacgctaccttggccggacatacattcgagcatgagttgcaagccgccgccgacgccggcatgttgtgcagtatcgacgcaaaccgtggcgattaccagaatggttgggatacggatcaattcccgatggatatctatgagctggcacaggcttggctggtcatccttgagggaggtggcttgactaccggaggtacgaacttcgacgccaagacccgccgtaattctacggacttggaggatatcttcatcgctcatatcggtggtatggacgctttcgcccgtgccttgatgatcgccgccgatatccttgagcactcagattaccgcaagatgcgtgccgagcgttacgctagtttcgatgccggtgagggcaaggcattcgaggatggcaagcttacgctggaagatcttcgtacgatcgctttgcgtgacggcgagccgaaacagatcagcggtaagcaggaattatacgagatgattgtaaatctgcatatctaaataattgaaaatcgagaattgggaattgaaaattatcgtgcgtaagccctagttttcagctctcaattctcagtttttaattaataaatctattccatgaaaagtaacaacacttatattttcgctcttaccttggtcgctaccttgggaggtctgctgtttgggtatgacacggcggtgatctccggtacggtagagtctttgcgtaagttcttcatcgagccgcaagggcttccgttggatcaagccaacgccttggaggggttcgtggtgagtagcgcgttgatcggatgtatcctcggcgcctcgttcgccgggtggatcagccagcgttacggcaggaagcctacgttgatactggccgctatccttttcttgctttccgctatcggctcggcttggccggagctgtttatcggcatgcccggaagtggcgatcatacgtttatgtatgcgttcgtggcttatcgtattctgggaggtatcggcgtggggctggcctccatggtatcgccgatgtatatcgccgaggtggctccggccgatcgccgggggaatctggtggcatggaaccagtttgccattatctttggtatgctggtggtatatttcgtgaattacacgatcgcccttcaaggagatgccgcttggctgaatacgatcggctggcgttggatgttcgcttccgagattattccggcggtattgttcctctcgttcttgatgttcgtgccggagacgcctcgttatctcgtgatgcgtgggcgtacggagaaggcgttgggcgtcttgagccatttgatggatcaggcggacgctggccgtgagctggaggatatacggaatagtttcaaggagaaagctccgtcgatgaagccttacttccggtttatggggacttggctggcgctgttcttggccggctacgggttgttgtcgtgggcaggtaatacgaacgcgttggagatcgccttgttggctagtttctgtatcgccttgctgttcccgatccggtcgtttggcgtgctgatcatcttggtgggcgtgttgctctccggtttccagcaattcgtggggatcaacgtggtgctttactatgccccggagattttcaagacgatgggagcggccacggacgccgcccttttgcaacagatcgtggtaggggcggtgaacctgtcgtttaccgtattggctattttcacggtggataagttcggacgccgtccgttgatgattatcggggcgctcgtcatggcggtatctatgttgatcttgggaactactttctatacgcgttcggtgggtatgggatcattggtctgcatgctggtttatacggcgggattcgctatgtcgtggggcccggtctgctgggtgctgctggccgagatcttcccgaactcgatccgctccacggtgatgagtatcgccgtagcggcgcagtggattgccaacttcttggtatcatggacattcccaatgctggataagaatcaatacttgaccgatacgttcaatcacggtatggcctattggatctatggcgtgatgggtatattggcggcgttgttcatctggaaatttgtccccgagacgaaaggaaagacgctggaggagatggaaggttattggaaacggtaaccaaacctgagacaagataatatatgagtaaaaaaggacggatcaatctacccgtccttttttcgtaatgaaccttaatgccccaatttagacgccggattcgccatcgccgcccgatagctctggaaagtaaccgtagatacggtcagtgtcattatgattaccaaagccactaaaaatacccatatgtagatcggcgttttataagcgaagcttcgtagccaaacattcaccccgtaataagcaagcgggatcgagataataaaacagacgagcgtgatccggaggaaagacgagttcagcatccaaaggatttgccggaccgtggacccatgtactttccgcacggctatctccttttcccgtccctgtagctcaaagataaccagtccgaatactcccacgagggataaaaagacggccatcaggcaaagggcggtaatcagcgctccctgccgcccacttttactgtaaagttcctccagcgccgtatcaaagaaatggatatcggccggataacccgggatcaattcatccgttaccttccggatatgctcgatagccgtccggggatttccgccggcgatcttgacataagcgtatctttccggcaccgaacggcggtaatgattcttagtcgaggtccaaagtcccatcgggcgtaactctttatacagggattcataatggacatcctcaaagataccgacaatccgtaccggtatatcattatccgtgatgcttgttcctaccaagtccgataggtcgtccggtttctcgggggaaagacccgaggcgatctccctcgctgccgtctcgctaaggaggcaaacggcctgcgtgttatccgccgcctcatccgtcggccggaacttccttccggcgatcatctttacatccattagctccgggaaattggcggatactcccagccagctcatataataatgttggcctttgtaattatacccgatgaaagaacgtgattcgtccgagacaaatttgaactcactaaaggaaacatcacggatagcggggctttccaagagacgtgccttgaacaattcgccctttttcaaggccgcccccatgcttagtcttacctccagtacgttttctttattgaatcccaagtccacgttccctatatatctgttttgcaaggagacgaacaacgctccgacaatcagcgtgatcgagataacgaactggaaccctataagtaacttgcgagtgttcttggcccggtcgctaagggtaaaagacttattcagcgctatgacaggaggaaacgaggtgatatagaaagcgggatacaaaccggccagtataccgccgcctgcgacaaggaagaatgtgtacgccggaatcttccagttggcatacagattcaacggatgccccaccatattcgtgacccattgcacgttattcaaaaataataggaaaagcaaggcgaggaagaaggcgacaaccgagattcccaaggactccaagaccagatacttccgtagcgtggcgtccgagcttcccagcactttctggatggtgatcgacttggtgcgtatcggtgccaaggctatcgacaggttgatataattgaccaaggcgatacctatgattaggatggcgataaagaataacatattcgtccgtagcttattaccgatgggagcggcgtccgctcggaccggctggccgaaatagagatcagacaagggccggaggcgcatatcctcgatcgtgaaacttttcaggaaagcccggctatcggccatataggtctcggtagtgacagaggcggattccggcgtcgacatcagcagataacaatagtaaaggccagtatgccagtcttccatcatctctttctccatgatcgggatatacagggcattcttcacccgggtgttttccgggaaattgcgaaagacgcctcccacgatatatgccggctcaaaactaagcccatatataatcgagccttcggccccggcgaactccgacagataaaccggcttcccgataggattttcctcgccgaagagtttccgggccatgctctccgggatcagcgtcccttccggacgtttcaggcaatccgtatcgccggccaccagctcgaagccaaagaccttagtatatcccggggtgatccgttccacctgctccatatagctccgtgcgtcgggtccttcactggctgatatcccaaaacgtacggaggagtaaacaaggttgtttgtgatagcggccgcttctatataaggggaggcggcgatgaaacgctcgagttgtggacgtgcgaaattagcctcccatatcccgtcatcccgcttgttttctaactgaaagatcctttccctgttcaagagggaagcgtcgaagctatattcatgaccgacatgtatgcttattagcatgaataacaggaaagcgaagctaagtcctaaaagattagtgaccgtcgctaatttataatgtctcaagacataaagcaggttcttgaatgtactttgcatggtataagttcttttaattttaaaccctttgatctggaaatacaaagcaaagctattcctttatttacgttcctgtgttatttttttgacaaacggttactttcagttgatgaattgtgatattatcaataatttccttatttttgccatcatacttcaaaaagaaacaagcgctatgttacacaaaggctatcggatgcttttcaactgcctgatgttttatctctagcagatactctccctatataaactcatggggggcggggatgcccgtcctgtgtaacaataaaaaataaccttgatgagggcggatagatcctacctctacgataaaacatataattttatgaatacaacccatcacacacattcatgcgtacatgataccgtctcttccgtgggagcgaacaatttcgggatgaacgaccgtatcaaacgtctgcgccggcagaccttcgaggcccaaccttccctctccatcgagcgggccttgatcgagacccgtttctatcaggagaattacgggaagtatccgatccctatcctgcgtgccctgaacttccttgagatctgcaagcggaagacgatctatatcggcgaggacgagttgatcgtcggcgagcgggggccccgccccaaggccgtgcctaccttcccggaacttacctgccatagcgtggaggacttgcatatattgaatacccgggagctgcaacgttacactatctcccaagaagatatcgatacctacgagcgggaggtgatcccgtactggaaaggccgtacccagcgggaacgcatcttcagtcacgttcccaaggaatggaaagaggcgtacgaggtgggtatgttcaccgagttcatggagcaacgtgcccccgggcataccgctttggacggcaaggtctaccaatatggcctgctggacttgaagaaacgtatcgagggggaactaagcgccttggatttcatgaacgaccccgaggccacggacaagcaggaggagctgacggccatgtctatctcctgcgacgccgcaatcctgctggccgagcgacacgcggacttggctgacgagatgtctctcaccgagaaagatccccgccgtgccgctgagctgaggaagatcgccgaggtatgccgccgggttcccgcccacgctccccgtacctattgggaagcgatccagatgtactggtttgtccacctcggtacgatcacggagctgaatggttgggatgccatgaaccccggtcatttcgaccagcatctggcgcctttctacgagaaagaaatcgccgccggaaccttgacccgtgacgaggcgaaagagttgatgtcttgcttcttcatcaaggtaaacaatcataccgccccgccgaaagtgggtatcacggcgaaggagagcggaacctataacgatttcacgaacctgaacatcggcggcatccgggcggacggtagcgatggcgtaagcgaggtctcctatatcatgttggagacgatcgaggagctgcatatcctccagcccggcagcgccatccacgtcagtgcccgtacgccggagcgtttccttcgtgccgggtgcaaggtgatccgccaaggtcatggctacccgtcggtattcaacccggatgtgtacgtgcaggagttgatgcggcaaggcaagtcgctgcgtgacgcccgcgagggaggttgcagcggttgcatcgaggtgggcgctttcgggaaggaggcgtacgtgttgaccggttatctgaacgtgccgaagatattggaggtgaccctgcataacggcgtagatccggtaagcggtcgcaaggtcggtctggagaccggcgatccccgtggtttccggacgtatgaggagctttatgcggcgttcattcgccagatccattatttcgtggatatgaaggtgcgggtcagcaactatatcgaccgcatgttcgccaagtacgcccccgccacgttcctctccctgtttatcgatgattgtatcgcgaagggtaaggattactacgatcgcgggcctcgttacaacaccacttatatccagtgtaccggattaggcacgataaccgatagcctttcctctttgcggaaacacgtcttcgaggataagaccttcacgatgcaggccttgttggacgcgatggcggataatttcgagggacatgagccgatgcgccaaatgatcctgaaccgtacgcctttctttggcaacgatgatccgtacgccgaccagatcgccgtccgtgtcttcgacgatttatatgacgcgatcgagggcaagccgaatacgaaaggggagtgtttccatttgaatatgttatccaccacttgccacgtctacttcggcaaggtgatgggagccaccccgaacggccgcttggccgggcgtgcgatctccgatggtacctcgccctcgcacggagccgatacccacgggccgtccgccgttgtcaagtccctcggcaagctggatcaggtgaagagcggcggcacgctgctgaaccaacgcttcctgcccagcctgctccagagggaggaggatatctcgaagctggcctccttgatccgtagctacttcgccttgggtggccatcatatccaattcaatatcgtggatacggaaacgctttacgccgcccagaagtgtccggaggactaccgggatctgctggtccgtgtagcgggctatagcgactatttcaacgatatgaacgccgatttgcaagcggacgtgatcgcacgtacggagcaagagactttctgagccatgctgttattcgatatcaaacgatacgccataaacgacgggccgggcatccgtatcacgatcttcatgaagggatgcccgcttgcctgcgtatggtgccataacccggaaggcatctcgccccgggcggagaagctgtatacgagaaagaagtgcataggttgcggggcctgcgtggatgtatgccccaccggggcgttgaccttgacggaggcgggtatcgtcacgaatcggtctctgtgccggacatgcggtagatgcgccgaggtttgtcccaccttggcgatggagatgtccggccgtgagtattctatcgacgaggtcatgcgtgagatcgagaaagagacggtctttatggatcgctccgagggaggcgttaccttctgcgggggagagccgttgtcgcgtccgtcggatttggttgccctgctggatcgttgcggagcgttgggaatccatcgtgcggtggatacgaccttgttcgcctcgccggataccgtccggagcgtaatggagcgcacggatctttttctggtggatttaaagcatatggattccggtagccatcgtcgtttcacgggtgtcccgaacgagcgtatcctctccaatcttcggatgatcgccgaggccgggatggacttcctcattcgcatccccttgatcgagggagtcaatgcggacgaggagaatatatcccgttctgccaccttcctagcctccttgccgtgggagcggaaagtcgttaatctcctcccgtaccacgacatcggaaaaggtaagcacgataagcgaggaaccctctacaatcccgggcaccttccgctatccaccccttccgaggcagtcctgcaaaggtgtatcgatcaattcgcctcctgcgggataaccgcgttgatcggaggatagttctctttgggaactattcttctttcaataattggttgattgtatgaatgaataattcggcttgtggatataagttatccaacatttccttatcacaataaacaaaatcgtcataatctccactatgtcttttctcaaataaagtcgagaatattttcccgatttttataggaagctttccggtagagataaaatgtaatccaagcatagtcttaactccattatgtgtttgtggttggtggtcatattttaatagcagggaaaccgctgcgtaatagcatgcataatagaggcgattaacggcagcattatagaaagactcacgcatcatcacttgagcttctttcaatgtctcataagcacgttggattcgatagttaatcaatgcgttcttactttcttcatctaggatctctttcataatataataccttcgtttataacattaatatagaaaggagttttaaagggacggttttcccagagttttcttaacatgacgatagggctgatatttacgcctgtctttagttccagctcatacaagggtaaagtaatttcttcctctcgttccaaagtcattttctctccgtctatcaagatgagtaagtcgatatcgctatcaatccgagcgtctccacgtgcttccgaaccgaataagatagtttgtgccgtgggagctatccggcgcatgatatcttttatctgatctataatttctgttcgtttcattttatcttttcattaaatgacttctgtcgtgagacaaagataattatttttctgattattaccatttcttccgatactccgtaggcgatatcccgacgtgttgcttgaagtatttaccgaagaaggattggttggcgaagtttagccggtctgatatctcttggatggaaagggtggaggaggataataacgccttcgcctccaagacaacgtaattatcgatccattccccggctgtacggttgctgacgttctttaccaaaagagataaatatttgggagtcacacataatttcccggcgtagaaagctaccgatcgttcctgcttatgatgtaaggcgagcgtttgtatgaacgccgcgaacaactcctcttgccggctcttcttcacctcgatcggcatatgattcttaaacatgccgtaaacctcgtggaataccgccaacaataagctctgggcaatctctttccggtaaggatgccctttcgctttcactttcttccagaggaaagaatgatattccttgatacaacctatctcctcggcattcaactcggtgaccggatgctccttgatgtagaagaacgccggcaaggtattctgtatatgaggaatgatctcctccatgaaattcttggagatgacgatgaagatcccggccacgtcctcgctacgttccacgtgttggatgatctgatcgggcaaggacaatacgagatggttttcccctacgacatattcctccatattgatccgtatacgcatgaagcctttcgtacaaagcgcgaatacgacggcgtctattcgcatcggatggtcgagcgagggaatatcgtcgatgttatcgaatatggcgaaatcctcgtcgataaagtctatgccgggtacgttctcgataagagagatacaagcttgaggtagatctgttacgttcataatttattcttgtttgggcgataaaattagtgaaataatagaataatccaattgaaatgtgtcaaataggacaatttggttgcaaaacggaacttctttggagtggataaactcatcatctttgcggtataataaatcatacgatatgaaaaggatgaaaggtattgtttatggaggattattatccgtcgtgttcgtgatgtccggatgctcgggcagtcaaaaagagggacgggatagcaaagagatcccggtggagatcgtgaaggtagcgaagaccgttccggcggatacaaggaattacgtgggaacggtagaggaggtcgtatcctcctcgattagttttcaggtgatgggtaatgtagagcgagtattggtgggcgaggggcagaaggtccgtgagggccaactactagcggtgttagacaaggcgacgctggaaaacgcctataatgcctcggccgcttccttgcgacaagcggaggatgcctatgcccgcatgagaaccttgcacgagaataagagcctgccggatatgaaatgggtagaggtggagagcaaattggaacaggcccgttccatggagcgaatctcgaggaaaaaccttgaggaccggaacctgtatgccccgttcggcggcgttatcggcaagcgcatggttgaggcgggagagaacgtgcagcccgggcaaccggttttctccttgttaaggatagagacggtaaacgtgaagatcgccgttccggagaatgaggtcgccacgctcggcgatcaagccgctatgataaaggtagccgctctgggcggacaatgttttgaggggaaagtgacggagaaaggcatcgtggccaaccctatctcccatacttacgaggcgaagatccggctggagaacccgtctggcgctttgttgcccggcatggtttgcgatgtacgcctgtcgggagaggaatccgtgccggctatcgccttgccgaacaacgccgtgctgatagcgaacgacggggggcgtttcgtctggaagatcgtagacggagaggcgaaagctacgcccgtacggacgggcgacttgacggagcagggcttgtttattctggaagggttgaacgagggggatatcgtcgtgataggcggttaccagaaaatcagtgagggcatgagagtgcgtgcgttatgagagaacgtaaaaacggagtgatcgaatggaccatgcgtcattaccagatcacgttgctggtgattaccgtgctggtcgggttgggtatttggggtttggtggacatgccgaaacaggaattcccggagttcaccatccgccaaggcgtggtcgtgggtgtttaccccggggcgacttccggagaggtggaggagcagttggccaagcctttggagagatacctgtttaccttcaaggaggtaaagaagaaaaagacgtactccatgtcaagggatggaatggtgtacgtgatggtggagctgaacgacgacgtgaacaataaagacgaggtctggtcgaagatcaagctcggcttgcagaacttcaagtcgcaactgccctcgggcgtactcgccgtcatcgcgaatgatgatttcggcgatacttccgccttattgatcaccttggaatcggaagacaagacctaccgggaattgcagcgatacatggagacgctggaagaccgcctgcgccggatcgagtccgtatccaacctgcgccgttacggggtacaaaacgagcagatctcggtctacttggatccagacaagctagccgcttacggcctagatacccgtatgctgatgacaaccttgttcacccaaggctttaccaccgcctccggctccttggagaatggcggcttggacattcccatccacctttccgtgacttatccctcggagcgggaggtaggcgagcagatcctgctggccgatgccgacgggcatatgatccgcttgaaagacgtggcccgtatcgtgcgggaatatcccgagccggatagctatataacgaacaacggcaagaaagcgatcatcctttccatggagatgcgtgagggccataatatcgtacgatacggaaaggaggtagacgaggtattgcacgctttcgagcgggatcttcccgggagtgtctcgatccgccggatcgccgaccagccgaaggtggtgggagactcggtaagttccttcgtgcgggatttgttcgtgtccatcgtggtcgtgatcttggtgatgatggtattgttcccgttccgctcggcattggtggcggctacctccatcccgatcagtgtctttatctcgatcggtgtcatgtacgcttgcggcatcccgctgaatacggtgacgctggccgccttgatcgtggtattgggcatgatcgtggataactccatcatcgtgatagacgcctatctggaatatctggacaagggctattcccgttggtacgccgccgtctatagcgccaagaactatttcagctcgatcttgttggctacgctgtgtatctgcgtgatctttttcccgttgcttttcacgatgacggggcagatgttggatttcgtgaccttcttcccttggacgctttccatctccctcatggtgtcgctggcggtggcgatggtctttatcccgctgctggagcgggtcttgatcaagaagggattgaagtccgggcgggagaatacgggcaagaagaggttcaatctgctggataccgtacaggccgtctatacgagggcactgacgtggactttccgtttcccgaaaaccacgatcggtctgggcgtcttgacggttgccttggcgatcctgatgatcacccaactgagccagcgtatgatgccgatagccgaccgggatcagttcgccgtcgagatctatctcccgcagggaacctcgctggaccgtaccgccgccgtgagcgatagtctctataagctgttgtcggaagatgagcgcatcctgtccgtcacctcctttatcggaacttcctcgccccgtttccaagctacctacgcccctaacttggccgggaagaattacgcccagttcattgtcaacaccgcctcgatagaggccacccgtagcgtgttggatgattatacggaccggtacgccgattattttcccgacgcctacgtgaagtttaagcaactggattaccaaaacgtatcctctcctttagagatccgtttcatgggagacgatatcgcccggttgaagcaggccggggattccttgatggccgtgttgcgtgagatggacggcttggtctgggtacacaccaattacgaggaggccttgcccgacgtacgggttcgattggacccggtggaagcctcccgcctcgggatcacgaaggcgatggcctcggccgatctggcgatccgttacgacggcctctcggttggctccctctgggaaggcgattacgctttgccgatccagctgagatccgataagaaaggggagggtgacgcgttcgataaggtcggcgaccagtatcttcccaccatcgtccccggcgtgagcgtcccgctccggcaagtctccacgatcgagggaggctggaatgaggggcagatcgtccgtcgcaacggcgtgcgtaccttgagcgtcttcgccgaggtaacccgggggaccaaccagaacgctatgcagaaacggatcgagcgagtcatggaaagccgtattatcccgaccttgcccgagggcgtgacgtacgagtacggtggagccaaggagctggatttcgagacgatgaacccgctgatgcagggcttggcgatcgccgtgatcattgttttcttcttcctgttggtcaatttcaagaagatcggcttggcgttggcggccctgtcctcgttgctgctcaccttgttcggggcggcgctgggcttgtgggcgttccatatcgatttcagcttgacgtgcgtcttgggcgttatcagcttgatcggtatcgtggtgcgaaacgctatcttgatattcgagcatgcgcaagacttgcggcttcataagcattatagcccgagggatgccgccttcgacgccggccggcgacgcatgctcccgatcttcctgacctcggctacaacggccgtgggcgtggtgcccatgatcatcagcggcagttccctttggatgccgatgggtgtggtgatctgctcgggaacggtcttctcgatgatcttggcggtcatcatcctgcctgttttctattggaagatattcgggaataaatgaatgatacggatgtggattaggatataatataggaatgaatatatgcggaaaaaagagatgataaaaagatggatatatggcatcgtcggttccctcgtcttatgcgtggggaccgtgagcgcccagcggacattatcgctggaagaatgccgggaaatggctttggagaataacgcgaagatgaagaacgcccgtttggacgtagaagaggcgagggaaggaaaaaaggaggcctttacgaaatacttcccgaatgtcagcgccgtgggaacagcttttaaggcgaaccacgggatgatggatatgagcgtgataccgggccttctcgagttgtcgatgatggatgacggcttgctgggtggggtgaccgctatccagcccgtgttcgccggcggacagatcgtgaacggcaataagctggccgacttggcgctcgaggtgagccgttaccagatgcgccaatccgaggatgaggtagccctgacggtggagcggtattactggcaatggatctcccttcacgagaaattaaggacgatcgagatcgtggaatccttggtggggagtctttataaggatgtggaggtagcggtcggcgccggcgtgacgactcgtaatgacctactgcaagtccagttgaaaaagaacggcgtggcgagcgaccgcctgcgggtggagaacggcttgcgcctctccaagatggtgctggctcaatatatcggtatcggggaagatgatttcgagatcgatttcacgctgcccgccgaggtgccctccccggagctttaccgggtgagccatgaggaggcgctccctacgacactctcttataaattgctggagaagaacgtggaggccgcccgtcttcaacaaaagctgaaggttgggcaatacttgcccaccgtggggatcggagccgggtatatgtatcacgacttactggataaggaccgtccgttcggcatggttttcgctaccgtagcgattccgatcagtgattggtggggcggctcgcacgccatccggaagcaaaagcttcaggtgaaggcggccgagtattcccgccaaaacgccaatgagcttctgttggtgcaaatgcggaagctttggaacgagctggaggagtcttataagcaagtcaagctctcggaggagtccatagcgacggccgaggagaatgtccgccttaatacggactattataaggcgggcacggtaacgctgagcgatcttctggacgcccaatcgctcctccagcaaagccgtgaccagtatacgggtgattatacggcttatttgatcaaacgtacggaatatttacaggcgacagggcgttaatttattttttttccatatatttgcttattaacaaataataaaacgagaagtgatgatgagctacgccaattatctttacatagcgatccgtgccgcggtagacgcaggcaagtcgatcatggatatctataacgaccccgaatcagacttcgggatagagagaaaagcagacaactcgccgttgacaaaggcggataaggcggcccatcgattgataacaaacgctttgtccgttaccccgtttccggtcttaagcgaggaaggaaaggagatcccgttcaaggagcgctccaaatgggagacgctgtggatcgtggacccgctggacggtaccaaggagtttatcaagaaaaacggcgagtttaccgtgaatatcgccttggtggagaaaggtgtgcccgtgttgggcgtcatttatgtgcccgtccggaaggagttgtatttcgcctcctcctctgtgggtgcttataagtttacaggaatcgatagcagcagccagccctcgatggacgagatgaagcagcgggcgatacatttgccgatggcgctggcgcatcaaggagtcgtggtagtggcgtcccggtctcaccaaacggaggagaccaccgctttcatcgataatctccgcaagcagggaaagcccgttacgttgatcagtagcggcagcagcctgaagatttgtctggtagcggaaggctcggccgatatctatccccgtttcgccccgacgatggagtgggataccgccgccggccacgccatcgccaagtctgccggttgcgacatatatcatatcgacggcaagaccccgcttcgctataacaaggaagatttgcataatccgtggtttatcgtgaagtgagggggatgtgtattttaagttattgtcagcggtgggagacggagcatgctccgtctctacaagccgtacaatgcattcttgtttatttggttatgaacgaaatttagaagactaccttgtaagaatataagttggcccagaatcaatcattattggtctatatcccatataatcctaaaaataggttagcgaaaggagtgcgcacttgagtattcttattatttttgcgctcttaaaagtaaatacatgaattttgatatagtgtttgtgttgctggccctgatcggcatgatcgcagccttggtatgggataagatgcggccgggaatggttcttctgacagtggtcgtgttttttctctgcgtaggcattcttactcccaaggagatgctggagggctttagcaataaagggatgataaccgtagccatgctcttccttgtcagtgagggagtgcggcagagcggggctttaggccaattgatcaagaaactgcttcccgaggggaagaccaccgtcttcaaggcgcaggcgaggatgctcccgcccgtggctttcgtgtcggcgttcctgaataatacgccggtggtggttatttttgccccgatcatcaagcgatgggcggaggcggtgaggcttccggccacgaaattcttgatccctctctcgtatgtcacgatattgggcggtatatgtaccttgatcggtacttctacgaatctggtggtgcacggcatgattctggaggcgggatatgagggctttacgatgtttgagctggggaaagtcggtatttttatcgctatcgccggtattttatatttgttcgctttctcgaataaactgcttccggactcgaggacggatacggtatccgaagacggggaggatgagaatcccgggaatttccaccgggtggaggccgtgctgggcgcacgcttcccgggtatcaacaagaccttgggagagtttaactttacccgccattacggggcgatcgtgaaagaggtgaaaagcggcggacagcgttttacccgtaatctggatacggtggtgttgcatgagggcgataccttggtgttgtgggcggacgattcttttatccctacatggggtgagtctagtgtcttcttgatgttggcgaatggtaatgaggcaacggagccggtatcgaggaagaaacgttggctggctttaggactgttgatctttatgattacgggggcgacggtaggagagttgccagtcgtgaaagaggccgttccaagtatgcgcttggatatgttcttctttgtctgcattacgacaatcatcatggcgtggactaagatcttcccgccgaagaaatacacgaaatacatctcttgggatatcttgataacgatcgcttgtgccttcgctatcagcaaggccatggagaattccggctttgcctccatgatagcccgccatataattagtatggccgacgatttaggaccgtatgcgttgctggcgattatatttattattaccaatatatttacggagttgatcacgaacaacgccgcggcggcattgagtttcccgatcgccttgtcggtggctacgcaattaggcgttgatccgaccccattctttgtcgtgatctgtatggcggcgtcggctagtttcagtacgccgatcggctaccagaccaacctgatcgtacaaggcgtgggaggctataagttcacggatttcgtgaaggtgggcctgcccttgaacttgatcacgttcttgatctccgtgtttgtaatacctatgatatggaagttttagaaaataatatctatccgattttcgaccgtatgctgggtcgtgaggataaagaggcgcttctggggcaaaggggagtgatggtgtggttcacgggtttgagtggctcggggaaaagcacgatcgctatcgccttggagcgtgagttgcataaacggggattgctttgccgcatcctcgacggggataatatccgtagtggtatcaacaataatctcgggttctcgccggaggaccgggtggagaatatacgccggatcgccgaggtgggtaaactgtttgtcgatacgggtgttataaccatagcggcttttatcagcccgaacaacgagttgagagagatggcgtccgctatcatcggtaaagcggatttcttggaggtttacgtaagtacgccgctcgccgagtgcgaacgccgtgacgtgaaaggcctgtatgccaaggcccggaaaggcgagatcaaggagtttaccggggtttccgccccgttcgaggcgccggagcgtccggacctgtccttggatacctccgtattgagcgtggagcaatccgtgagccggttgttggagttgatcataccgaaagtagaaattaaacactgaaaaaagatatgtctgattacaagttaagtcatttacaggagctggaggccgagtctatccacatcatccgtgaggtagccgccgagttcgagaatcctgttatgctttattccatcgggaaggattcttccgtgatggtccgtctggccgagaaggctttcgctccgggtaaggttcctttcccgttgatgcacatcgattcgaaatggaagtttaaggagatgatagagttccgtgattcttatgcgaagaaattcggctggaacttgatcgtggagtctaatatggaggctttccacgcgggcgtgggcccgttcacgcatggaagcaaggtgcatacggacttgatgaagacgcaggctttgcttcatgccttggataaatataagttcgacgccgctttcggcggcgcccgccgtgacgaggagaagagccgtgcgaaagaacgtatcttctcgttccgcgataagttccatcaatgggacccgaagaaccagcgcccggagttgtgggatatctataacgcccgtgtgcataagggcgagagcatccgtgtatttccgctatcgaactggacggagctggatatctggcaatatatccgtctggagaatatcccgatcgttcccctgtatttcgccaaggagcgtccgtgcgtggagatcgacggtaatttgatcatggcggacgacgaccgcttgccggagcaataccgggaccagatccgtatgcgtatggtccgtttccgtacgttgggctgctggccgctgaccggcgccgtggagagcgaggcggatacgatcgagaaaatcgtggaggagatgatgaccacgacgaagagcgagcgtacgacccgtgtgatcgacttcgatcaagacgctagtatggagcagaagaaacgggaagggtatttttaacacagaagagacatggcagatacaaaattaaatataaaggaattcctagataaggacgagcagaaggacctgctgagattcttgaccgccggctcggtggatgatggcaaatcgaccttgataggccgattgctgtttgatagtaagaaaatatacgaggatcagttggatgccttggagcgtgacagcaagcgtatgggcaacgccggcgagcatatcgactacgctttgttgctggatggcttgaaggccgagcgtgagcaaggtatcacgatcgatgtggcttaccgctatttcagcacgaacaaccgtaagttcatcatcgccgacaccccggggcacgagcagtacacccggaatatgatcacgggtggttccacggcgaatctggcgatcatcttggtggatgcccgcacgggcgtgatcacgcaaacctgccgtcacacctatctggtatctttgctggggatcaagcatgtggtactggccgtgaataagatggacttggtggacttcgacaaggatacgttcgaccggatcgtggcggattataaacgtttcgtggagccgctggatatcccggatatcacgtatatccccttgtcggccttggatggcgataacgtggtggagaagagtgatcgcacgccttggtacgagggtacgtctttattggattatctggagaacgtgcctatcgacttggatcgtaactacgaggacttccgttatccggtgcaatacgtgttgcgcccgaatctggatttccgtgggtttagcggcaaggtggccagcggtatcgtgcgtaagggagatacggtgatggcgttgccttccgggaagacctcgaaggtaaagagcatcgtcacctacgagggtgagttggagcaggctttccctcctcaatgtattacgatcaccttggaggacgagatcgatatctcccgtggggagatgctggtgcacccggataacttgccgatccgcgaccgtaatttcgaggccatgctggtgtggatggatgaggaagccatggacgtgaacaagcagttctacatcaagcagaccactcatacgacacgtgcccgtgtggatagtatccgctataaggtgaacgtgaacacgatggagcagtcttccgtggatcatctggagctgaacgagatcggccgtgtggtatttactaccggcaaggagttgttcttcgatccgtataggaggaataagcagaccggctcgtttatcttgatcgatccgattacgaataatacgtccgccgtgggtatgatcatcgaccgtgtggacgctaaagatatggtgacggaagacgctttggctaccttgaacctcccggagatgggaatcggagaggagcactatgaggcgatccgtaaggtttgtgaggagttgggccggcagggcgtatctgtgaaatgtataacggaaaaacgataggatatgggattgttggagtttgataagctaccgatcaatacgttggtcggggcggattgggatacgttcaggaaggtgacggcccggcagcagatagacaagggctttaagggtaagtatcgccttacgaccggtgtttgccgcctgttgagcgccttgaagccgatcgaggatagccggttcaagaaattggccgataagccgctcgagatggaccccttgtttatcttggggcattggcggagtggtacgacttttgttcataatatcttcgcctgcgataagcatttcggttataccacgacgtaccagacggtattcccgcacctgatgctctggggacagcctttcttcaagaagaacatggctttcttgatgccggataagcgtccgaccgataatatggagttgaaggtggatcttccgcaagaggaggagttcgccttgtcgaacatgatgccttatacgtattataatttctggttcttcccgaaacgctggatggagtattgcgatcgttacttattgtttaacgatatcacggaggaggagcggcggatcttcatggatactttcatgcgtctggttaaggtttccctctggaatacgaacggtacgcagtatttgagcaagaacccaccgcatacggggcgtgtgaagactttgctggagatgttcccgaacgctaagttcatctacttgaagcgaaatccgtatacggtattcgagagtacccgcagtttctttacgaatacgatccagccattgcgtttgcaggatatcacgaacgagcagatcgaggcgaacttcatcgaggtatatcgccgtcttttctataagtacgaggaagagaagcacctgataccggaaggcaatctggtggaagtgaagttcgaggatttcgagaaagacgctttcgccatgacggaaaatatctacgggacattaaacttacccggctttaaggagtctaaggcggatatagagaagtatctgggcaagaagaagggctacaagaagaaccaatacaagtacgaggatcgtacggtccggcttgtagaggaaaattggggcatggccttgaaggaatggggctatagcttataaataaaagggttagataggtattaaattgatagagggatggggttgagtttaagaaagaaagcgttatttttggcaatcgcttgtatgcctttgtccgtggttctcgcggacggggatggggtgacatcggagaatgtggtgcccttcgcttatggagacatggataattggattgtccgtgagattcatgagtctggcattatcgggggaaatacgaaatggctttatgagctggggccctcggatacgattgtcggtaatacggcgtttcgtaatatgggcggttctccgtgggctacttccaacgtgatggcgaaagtggcgggagtggtgaaaaccaatacgtctgttttcccggagaaacggggggatgggatgtgcgcccgcatggagacccgttatgagagcgtgaaggttttcggtttggtggatatcgaggtgatcgccgccggctccgttttcttgggtacggtgcatgagccgatcaagggaacaaaaaaccctcaagcgatgttacaatcaggagtgcctttctccaagaagccgaaagcgttgcggtttgattataaggtgaaagccgctcccgagaagaatcgggtacgtagtacggggttcagccgtaagagtacggtggccgggcaggattccttggcggtgatcttgttgttgcagaaacgatgggaagacgcggaagggaatgtttattccaagcgggtcggtacgatggtgcaacgctatacggaatctacccctgattgggtaaatgacgctacttacccgatcctttatggaaatataacatccaaacccgaatataaaccgtatatgcgtatacaagtagaggaacgttatacgttaaatagtaaaggaaaaagcgttcctatccaagaggtaggctgggcggagccgggcgaggcacctacgcatatggtgttgcagttcacctccagccacggaggggcctatatcggctctccgggaaatacgttttggatagacaacgtagaattaatatactaatatggtcgaagcaaagataaaagccctgcgtgatgagctggagcggcataattataattattatgtgctttcggcaccgacaatatcagactttgagtttgataagatgatgaaagagttgcaggaactggaggcggcgcatcccgagttcgccgatccggattccccgacccggagggtggggagcgacctctcgaaagagtttgagcaagtggtacataaatatccgatgctttcgttgggtaatacgtactccgaggatgagatccgagatttttatgatcgtacggtccgctccttgaatgagcctttcgagattgtggcggagcttaaatatgatggtacttctatctctttgacctatgagaaaggacgcttgacgcgtgccgtgacccgtggcgacggcactcgtggtgatgacgtgacggcgaatatcaagaccatccgttcggttccattaagactccggggttctgattttccggaggagttcgagatccgtggcgaggtattgctgccttgggcggagttcgatcgcttgaataaggagcgggaggagcaggaggaacccttgttcgccaatcctcgcaacgccgcttccggtacgttgaaacagcagaatccggctatcgtggcctcccgtaagctggatgcttatttctattatttattgggtgagaacctgccggccgaagggcattatgagaatttgcaggcggctcgcgcatggggttttaagattccggacgtgatccgtaaatgccagagcctacaggatatattcgattatatcgcatattgggatgtggaacgtaagaacctgcccgtggcgacggatggaatcgtgttgaaggtaaactcgcttcgtcagcagaggaacttaggttttacgtcgaaaagccctcgctgggcgatcgcttataagtttcaggcggagcgtgccgagactcgcttgaactcggtctctttccaagtgggacggacggggacggtcactccggtggcgaacctcgagcccgtattgttggcggggacggtggtgaagcgggcttccttgcataacgccgatattatcgaggggcttgacttgcatatcggcgaccaagtgtatgtggagaaaggcggggagatcatcccgaagatcgtgggagtgaacgtggaggctcgttcgatgctgatgggggataaggtccgctttatccgtgtgtgtccggagtgcgggactcctttggtgcgtccggagggagaggcggcacattactgtccgaacgagtcgggctgtcctcctcagatcaaggggcgtatagagcatttcgtgacccggaaggcgatgaatatcaatataggcccggaaacggtggaggatttgtacaacgccggttatgtaaaagactcggcggacttatatacgttgacggttgccgatttattgcgtctggaacggtgggcggagaagagcgcccagaatctgatgtcgagtctggaggaatccaagcaagttccttttgagagggtcttgttcggtctggggattcgtttcgtgggagagacggtcgctaaacgcttggcctcggctttccactcgatcgaggcattggagcaggcgtccttagaggatttggtagccgtggacgagatcggcgagcggatcgcccagagtgtattgagttatttctcggacgagaagaaccgtacgttggtgaaccgattaaaggaacagggcttgcggatggcggtttccgaagagcaattggcgaaccgttccgagaagttgaaaggactgacgatcgtgatcagcgggacattttccaagcattcacgtgacgagtataaggcgatgattgagcaacatggcggcaagaatagcggctccgtctcggggaagaccgattatatccttgccggcgagaatatgggaccggccaagctggagaaagcggcgaagctgggtgtgaagattatcaacgaggatgcgttcttaaatatgctggaataaatgtttacgaattattttatcaagaagaagatacaggctttagtgtcggacgctgccaagcgtccgcatcgttccctttccttggatgaggcacgttcgcttttggtcttgtataatatagaggatcacgaggacgtcatgagggccttggagcctttgcgcaaggcgaagaaggacatcaagacgtgtgtatatgtgccgtccggaggagcggatattcctttcgacgattccaatattcctgtacatataaagaacgatctcaacgcgtggggattcccttccgatagtgtcttggaaaaggtgggcgctctcaaggcggatatcttgatcgatatcacccggccgggttgttatgccttgcaatacatcgctctccggcatccatccgccttcaaggtcgggattaagtatccgggccaagaatggtacgacttaggcttgactgtaacagataaggacgatattcagtatttattcggacagatattattttatttgcgttccatccgtgctaaatgatataatttccttatttttgcagtgctaaataacaaaaaggaatattttccccatggcagacataaatttaaaaggaatgggtgtggcgttgatcacgccattcaaggaagatgagagtgtagattacgaggcgttaggcaagctggtggattatcaggtgcagaacggtacggattatttggtagtgctgggaactacagcggaaacccctacacttacggaagaagaaaagaaaaacattataaacttggtagtgactcgtgtacggggccgtatccctatcgtattaggcgtgggaggtaattgtacacggtcggttgtcgagaaattgaagacagataatttcgagggtatcgacgctatcctctcggtcgtaccttattataataagccttcccaagaagggatttaccagcattacaaggcgatcgccaacgctactcatttaccgatcgtactctataacgtaccggggcgtacgggtgtgaacatgacggccgagactacgcttcgtatcgcccgtgagttcgataacgtgatcgccgtgaaagaggcttccggcaatatcacccagatggatgatatcatcaagaacaagccggcccgtttcaacgtgatctccggtgacgatggtattactttccctttaatgacattaggtgcggtgggagtgatctccgtgatcggtaacgccttccctcgtgagtttagccgtatggtacgtctggccttggcgggtgattatgatagcgcacgtacgatccatcatagcttcacggagctgttcagcctgttgttcgtggatggaaatcctgccggagcgaagagtatgttaaatatgatgggctttatcgagaataagcttcgtttgcctttggttcctacacgtatcgtcacgtatgagaagatccgtgaggtgttgcgacagttgagcattaagtgctgatccgcttttaacggcaacgattcttattatttatataggataacaaaaggggcttcatgtgtcatagagggcatgtgaagcctttttctatagatatgctccaactcctcataccgatacttcaaccttgatttcggtcacttcattattttatgtcgggcaggcaaacgcttaccttttatttttgtaactattatattaaataaatgaagtgatgtttaaagcgattgtccatttttctattcagaagaaactattcgttgggttgacaaccttgtttctgcttctgggaggaatctatgccatgatgactttaccgatagatgccgtaccggatataacgaacaatcaagtgcaaatcgtgacggtatcgccaaccttggccccgcaagaggtagagcaattgatcaccatgcctatcgagatagcgatgagtaatatcatgaacgtggaagagatccgctccgtttcccgctttggcctgtcattggtaacggtcgtgtttaaggaaagcgtgcctaccttggatgcccgccaacttataaacgagcagatacaaaccgtggcgggagaaatccccacggaactgggtacgccggagctgatgcctatcacgaccggcctgggcgagatttatcaatatgtattgagagtggagcccggttatgaggagaaatacgacgccatggaactccgtaccattcaggactggatcgtgaaacggcaactgagcggtataccgggtatcgtggagatcaatagctttggcggctatctgaaacagtatgaggtggcggtagatccggatgccctttattccttgaatattacgatcggcgaggtgttcgaggcactcaaccggaataaccagaatacagggggcagttatatcgagaaaatcaataaggcttactacatccgtagcgagggaatgatcggcaagataaaggacatcgagcgcattgtgatcacgaaccgtggagggataccgattcatataagcgatgtcggctcggttcgctttggttccgccaagcgttttggcgccatgacaaaggatggcgagggagagtgcgtgggcggtatcgccatgatgttgaagggtgcgaacgccaatgtcgtgaccaaggaactggaggcacgggtcgaaagggtacagaaaatgttgccggaaggtgttcgtgtagaaccttatttgaatcgttccgaattggtagaccgaaatatatccaccgtgatccgtaacttgatagagggagcgttgatcgtctttatcgtattgatcatcttcttggggaatgtgcgggccggcttgatcgtggcttccgtgatcccgttggcgatgcttttcgcttttatcttgatgcgtgttttcggggtctccgccaacctgatgagtttaggggccatcgatttcggtatcgtggtcgatggatcgatcgttatattggagggaatgttggcgcatatctattcgaggcggttgatggggcgtacgctctctgccgaggagatggaccgggaggtcgaggccggagccggtcatgttgcccggagcgctacctttgccgtattgatcattttgatcgtcttcttcccgctacttacgctgaccgggatagagggcaaatattttacccccatggcgaagaccttggtgttttgtattatcggggctttgatcctttcgctcacctacgtgccgatgatggcctccctgttcctaaagcgtacgatctcttcgaagcctacattcgccgatcgtttcttcgggaaattaaacggggtttacaggcgtacgcttcatttctgtctgcgtcatatctggggaacgatcgcttgttctttcgcggctctggctgtgtcccttttcttattcacgaggttaggggcggagtttatccctacgctggatgagggggatttcgccatgcagatgacgcttcccgccggtagttccctgacgcatagtatcgagctatcgaagcaagcggaagagaccttgatgaagaatttcccggagatcaagcatgtggtagccaagatcggaacggccgaggttccgaccgacccgatggcggtggaagacgcggatatcatgatcgtgatgaaacctttcaaggaatggacctcggcctccagccgtgcggagatggtggagaagatgaaggcctccttggaaccgattacgggggcggagtttaatttcagccagccgatccagcttcgcttcaatgaattgatgacgggagccaaggcggatatcgcgatcaagctatatggagaggatatggcggagctttataagaaggcgaaggaagcctctcttttcgtggagcaagtaccgggagccgccgatgtgatcgtggagcaggcgatggggctgccgcaattggtcgtacactacgatcgtgccaagatcgcccgttacgggatgaatatagaggagttgaacacgatcatccgtacggcttatgcgggagaggcggcgggtgtcgttttcgagaatgagcgacgtttcgacttggtgcttcgtctggataacgataaagtggcggatctgaatttggataagctctttgtacggactgccgagggaatccagatcccggttagcgaggtcgctacgatcgggctggtcaacgggcctctacagattaaccgggatgccacgaaacgccgtatcgtgatcggggtgaatgtccgtgacgctgatatccagaaagtcgtgcgtactatccaagaaacccttgacaagcatatcaagctggaaccgggatactactttgagtatggcggccagttcgagaacttgcagaatgcgatcgatacgcttacgatcgtgataccggtcgccttgtcattgatcttattgctattgttctttgcctttaagagtgttacctactcgctggtggtattttctaccgtcccgttatccttgatcgggggtattctggccctttggttacgagggttgcctttcagtatatcggcgggggtcggttttatcgccttgtttggcgtagcggtcttgaatggtatattaatgattaatcattttaataacttacgaaaacaaactaaatatcaaatgacaacgaatcgtatcctcgcgaaaggatgtccgcatctacttcgccccgtattcttgaccggcttggtagcttctctaggattcgtgccgatggcgatagcgaagtccgcgggcgcggaggtgcaacgtccgttagcgacggtcgtgatcggaggcttgattgtctccacgatcttgacgttgattattatcccggtattttatcggttggtaaatagctcggccgcttggaagcgccaacgctggttgaagcgcctattgccgtttcttctttttttaggtatcttattccccacgcatgcccaacagacggtgtcgttggaagaagccgtgacgatcgccttggagaatcatcctcgcctgaagactgccacggcatccattgaacgtagtcgtgcttcacggggagagagctgggaggtgtcaccgaccacctttaattattcatggggacagatcaacggtgagacacgaaacgacaatcaaatggagatcacgcaatccttgggctctctattgaccccattttataagaacgccttggtgaaccgtcaagtcgccacgggagaatattaccgggacttggtgaagaaggagattacggccgaggtaaaacgggcatgggcttattatcaatatgcctttcatctatgtgccttgtataaagagcagatcgagtgggccggacgtttgcgaaaggcaagtcagttgcgttatgagcaaggggatatcacgctattggagcggaatatgtcatctaccttggtcgccgatctacagacccgtttgtcgcaggcggaagaggagttgcaattggctacccgtcgtttctcttggacttgttattcggattccccattactgcctatggatacgacattggttttattccccgctcgcgtagccgagatcgctccgtccgatatccatctgaattatttccggagcgtggccgatgagaagaaagccatgcttcgtatcgaacgaagccgtttcttcccggaactatcggtaggatatgtgcgtcagaaaatagccccgttgagcggtctggactcttggatggtcgggatctcgttcccggtattgttcttcccgcagcatagccgggtaaggcaagcgaagatcgattcctatatcgcccgtacggaagcggagagtaacatccgtcaattgaacaataaggtggaggagttgagcgtcgcgcttcgtaaggaaggagagcatatccgctattatacgaccggcgctttaccggaagcggaggctttgttgaagagcgcgacggtacagttcaaagagagcgagacagatatcacgcagtttgttcaaagcctgaacgccgcccgggagatccggcggggatatatcgaggccgtatatgcctataatatatcggcgcttgagttggagttgtatagtagataaccagaaaaatcgtataagatgaaaaagatatggattcctgcggctcttatggcattggccgcatgcagtatgacaaacaacgcggagaaaggacagggcgattcgcaagacataactgcccggcccgctattactcaagtagcagaaaacataccgtccgaaccatccgtggatagcgtagaggtggatgggatttcctcggctacggcccttccgaatcactcctctttcaacgggatcatggtagttcccccgcagcggcaggctacggttacattgacgatgggaggcacggttcatgctactacgctgcttccgggcgattatgtgaagaagggctccgtggtcgtcagcttggagaatccggattttatcacgttgcaacagacctatttggatgcccatgcccaaacggaatacttagaggctgagtataaaaggcaacagcgtttgagcgagcaagaagcggcctcgcaaaaacgtttccagcaaagcaaggcggattatctttccatgaagagccgtcaagatgccgccgccgcgcaactcgctatcctaggtgtctccgccggcgatcttctggaagacggtatccaaccttatttggaggtaaaagcgccattaagcggttatgtcgccgggctgtccattaatctcggtaaatacgtgaacgcgggcgaaccgatctgtgatgtgatcgataaaggcgagactcttctttgcctgaccgcttatgagaaggatttagcggacttatccattgggaaccaagtgcagttccgggtgaatggaatggggaaggagaccttccatgcggtcttggtctcgatcggacaggaggtggacgagacgagccgttccttggaaatgtacgctcgggtgaaagagacgaatccccgttttcgtcccggtatgtatgtttccgcacgggtagagaagaaatgactatctttgtcttcatgaagaaaatgaatataaagaataaatatgtgttctcgttggtcatcatatcgatcatggtggccttcttgatccatttcccggaattggtgtcgttgtttgacgttaccgggcagaacgctcttttcccggatatgtcggtattggatgtagcgaatgaggtctttttcaccttcgtgtccctcttactgttatttgcgatgaacacgtatgtctttggtttcaatcggcagaaagcgcatatctcttggcggaaggtcctgctctcgttcgtgatgacttggtgcgtgaataatttattaggaaagggtttcgtgttcttgcaccatcagtttgatatcccggcgatcgacgccttggtgcatcattatctgcatccgttgagggattttatcatgtcgtgtgtcgttacgggtagttgctatatgatttacctgattcgtcaaagccagcaagtacaggtcgagaaccagcaattgcgggcggagaatctattgaaccaatatgaggccttgaagagccagcttaatcctcatatgttatttaattccttgaatacgctccgttccttgatccgggagactcccgggaaggcacaagaatatttgcaggagttatcccgtgtcttacgttataccttgcaagagaatgagtgccgtagtgttactttacgggaggagatggatttcgtgaacgcttatatcttccttttgaaaatgcgctatgaggataatctggtcttcgatatagacttagggaaggagcacgagtctaagcaactgcctcctatgtcggtgcagcttttgatcgagaacgccgtgaagcataacgagatcagcaaccgtcattcattgaccatttccgttcgttctgaccatgattccttgacggttagcaatcccatccaaccgaaattgacacatagcggaggcaccggtattggcttggtgaacctgagtaaacgttataacctcttgtataagaaagatatttccataaaagaagatgctagtatattcagcgtaacaatccctttggtatgaaagctttgataatagaagacgagaaagcggctgtccgtaatttgatggcattgctgggagaggttgatccggatatcgaggtgatcgatgtcctagatagtattacggatagtgttgaatggtttcaatcgcatccaatgccggaacttatctttctggatatccatttggcggatggttcggctttcgagatcttcggtcatgtagatatctcttgcccgatcattttcacgacagcctatgatgaatatgcgctgaaagcgtttaaagtgaatagcgtagattatctgctgaaaccgatcgacgcggatgatatacggaaagctttggataagttgtcacggttacaatcgacggctgtggagaaagaagcgatcgattattccgctgtcatgcaagccttgaagcgggtggaaggatataaaacgcatttcttgatccctgtgaaaggggataagctgctacctgtttccgtggatatgatcttatttttctatatagcggacggaaatgtaaaggcggtgatgacggacgggaaggaataccttttcacgcagaccttggatgagctcgccgatagccttgatcctgccttgttcttccggatcaatcgtcagtacttgatatccagaaaggcggtgcaagatatcgatctctggtttaacggacgccttgcggtcaatttgatcgtaccgaccttggagcgtatattggttagcaaggcgagagtgccggatttcaagacgtggtttacgtcatgatggattatcaagaggattataggggtggagtacgatgaaccgggctccatgcttatacgtcgggtctaattgaatggagccacctaaatgctcgataatcgtttggctgatggataaccctaagcctgtaccctgcgcgtattcatctaccttttcgaaacgctcgaatatgactttctgcttatcctccggtattccacatccggtatcggttacggtgatacgtacatgctgtttgtcctcatctatttgataagataggttgatctctccttctttcgtgaatttgcaggcattagtcaataagtttatcaataattgttggagacgtatcgaatctgtctgaatatgtaaggggtcttcagaaggtgtataggtcaattgaacacccggaaagacccggtgctctacacttgctaaagcgttccggcaacaatccgataagtttgtcttctctataatgaacttcatattcccggattctaggcgagaaaggtcaagaatgtcatttatcagattaagtaataaataagagttattgttgataatggagaaaaactctttcttttcgccagtggaaatagattcatcggatattaattccgaaaagccgacaattgcgttaagcggcgtacggatctcatggctgatattggcgataaacgtgcttttcatctggttggcgtgttccgctatctctttggctgtacgaagttgacgctcggactctactaaggcttccttgtctttcataagttctcgttggtagcggcgtgcggagcgataggacttgtatacgatgtatagcatcactaaaagaacgatcgatactacgagtagaataatcattaacaacctttgggtatgcagttgttgttcacgtagctgtagctcgtatgcctgcatctcttgattgtttagatcatgtaatgtccggagctgattgatctgtcggttgaaggcctcgtcatgcaacatcttggtatgttctacaacttctctactaaatgcgagcgcttctttataacgtcccaatgcttcgagtatctcgactttcagctccgaggttcgtatatcttcttctgttaatttatttgtgtctatgatattcagcgcctttccatacttacctattaaataataatacttggcgaaaacgaagttgtagcagaattccgtataatcatctccggttttctctatgatcggtgtcgccttcaacaaggtctccaatgcctgcttgggcttgtcttgaaggacatacatatccgcataaaaaacatacattagcgcacggcaacgatccacggggaatgcggtgccttgttcttcattctctctttccctatcttggatcatttcatcgtaacgggttaataattcctcggcctcggtgaaatgatcggttcgtagataagattcgatgaggtttcccatgtattgcatctcgaatttcggattgtcacctcgtttctgtaataaatcgagaccttcccgataagctactatcgcgtcactatcccgatgtatttcttgatagattaaacctaagttctcattgcaacaaatcaatccatattcactctttgtatcacgggcatagttgtataggctgatcgccccgttcatcgctaactcataattgccgtcccatagatccatttggcaaatgaatcctcgcgcatcgaataatgcgtccggaacctcattcttggccgcggccaatgaatctatcttatgcgaccagtaaatcaggctatccctgttttgtatattgtaataatggcgggataagttggcccatgcgtaatataaggaagcatgacctttcgaagtggagcttgccacatctgccattttgtttaggtaaacaatctccttgggcatttgcctgtacattgtcgctaaatccttatataactcgatctgttcatttatggctggcgaggactttaatagggataaaaggctgtcttccctttgttgggtagtataggtgttttcccctaaagaaaacattgggatcattaaatagataaataatactaaataggtatttctcatgatattgtatgatgttcaatacaaaaatacattttaacattaaatatcaagcgtatgttatggaattttagaggtctgccttatagtttctttttcaaagtgaagaaaaaagtaaccccttttcccggactgctcttcgccgatatttgtcctttatgaaaattaaccccgtttttaacgatggataatcctaatccggttcctccgatcttacgactgcgtcccttgtctacccggtagaagcgctcgaatatgcgattgatatgttcttccgggatacccactccattatcggagaagctaaagtaataatatttaggatcttctttatagcagttgacggtaatccttatgttttctcccgcataagcgatcgcgttgtcatatagattccggaatatggaatagagtagggagttattcccgaacacggtcggatctcccgggaggataatttccgacgtgatgtgtttttcttccatatcttgggagcattctttttgtatctcggcgataagcttcgtgatatttacttccgtgaggtcgaacatctcggatgcctcgtcaagtctgtttaatacggaaatatctcgtaataatcctgtaaggcgggtactttgggaataacaacgttccaagaaaaattgacgtttgtccggactcaaatctgggttggataggattgtttccaaatacccttgaatgctgctgaccggtgttttcagctcgtgagagacgttctgcgtaagctgtcgtttcatccggctttcttcttcttgacgggatatatcattaatagagatctcataactattatcgaggaataaaatacattcgatcaagaatattttaccgttcttgtcaatagtcacggactctcttaatactttctttttccgattcagattccggatattcttattcaagaaggtacggattggttctaattcggctatatcagtaacgtcttccacttggtggatctgggtgtcggatatgacatttatgaattgaatgaataggatgttagaaagaatctcccgcccttcacttgtaaacatagcgaagccttccttggaatattggaaatgtttgataagcttttcccgttccatggataactcgtttttcgctttctgctgccgatggtataaggttacgatattctgtgagatatcacctagctcatcattcgggaaaacataatcgaccgcaggcattcgatctttctctacgtttaaggcgaaatcccttagtttggatatcgttttacctatgctgaaagtaaaacgggaaaggacaaagaagaaaatcaaggtcatcaatgccatgaaataaatgaagtccttgtttaccgtcaatatccctcttacatatggatcatagggcagggctgagcggtaaatataacctcctatatttgatgccgaatagaaatacctttttcccgtagattccgaggaacggatagcgaatccttcattatataatcgggctttgcgtacctcgctccggtcgttatggttattaaactcgtccgtcccgctattatcaaacaatacgtcgccggatggatctataatggttacccgcaaatccttttgagggatgtcgtccatgaaacttattacggtcttgttgatgtccgtactttgttggcatttgcggaataattggtaattatagttactcaacacattgttcaacttttcttgcgcgaactccctttcccgctgatattggaatagcaggaaacagaccgtaaagcccaagaacataaaaaagaccgaccagaaaagccgttggctaaacggtatccggtgccttttctcaccatctatctttaccatgattcacgacaatattagcattcaaaacaataaccgaaacctaagcgagttacgatgttctttccataaggacctattttcttacgtaaccgggtgatgttgacatcgatggtacggtctagaacatatacctcgtctttccagatgcgagacagtatttcctctctggagaagacgttccctttattttccaatagaagttttagtatctcaaactcttttttggtcaatggaacttccaccccgtctaccgtagccttgatgcgtttcgtatcaagagctaatgtctcatactcgagtttctcaatctctttatcttttgatttctcggaagttcttcttagtacggccttaacacgcgctatcacttggcggatggagaaaggcttggagatatagtcgtccgccccgagattgaaccctgtgagcatatcgttctccgtatctttggccgtgaggaagatgataggggtattggccgtcttctcatcttgtcgcaggatacgtgccatcttgaaaccggagatttctcccatcatgacatccaacaataataaattgtaaacggtcagatcctttttcaatgcctcttccgcactataggcggtatctacttcataaccttctatttctaagttgaatttaaggatctcacacaaatcctcttcatcatccactacaagaatacgagttgttgccataagctgttctgtttttaaaagagtgccttacggctctccatatacaaatataattatttttggcaaagaacggatattcttatttcggagaaatgaaatatatgttacattgctgttaagatcgctcatataacatttctgccgcaggatatgtgttagtataatagatcattagggatgctacttcctataataattataatccgtgacaaaaccctcgcaaagccagttggccaaggcttgccgattgttgctgaggatgatccgttgttggtcgtattggttttgtatgttgcccaattcgacgaatacggaggtcggggtcgtgtgacgtaatacatataagttacgatcgtctaccgtgcccgagaatccccggcccggctggtggcggttgtatttgcgcgagaaagtggatttcatcgttttagccaagcgcttgctcgcttgatccttgggcttatgatagaaaaagacatcggtcctttgatgccggctccggctgtccacatggatgaatatcgctctcttataagtttctttatctttccggctcaagctgtttatcttggcgcaacgctgatccagacggcttacttggctgagggggatcggactacccatacaagtttcccgtttgctgttattgaggaattgctggtcacgtattccgtcctttgcgtcttggatgataatatgtacctttgcgcctcgcgttaaaagattgcgtgccagacgtagcatgatgtcgtaagcgtattcatcctcatgcaattcatgggagcccattttaccgatcgccccggggtccggaccgccatgaccgctgaccagataaaagcaagctccctttaaatcggaagaggttactttgtaactggctagcgacttgccgaataggggctgataattcttcttctgaggggcggaggcgagcggaggcaaggtatattttacgcccatgcgcagagtgttatttttacccaacttccctttattaagctcgataaactctttctgatacgtcccgccggtacggttgaagcgtttgagaaaaagagtgatgccctctccgtttttcggatacgccttttcttgggcagtcaaggaacctgtatatacgagagcgataataaagaagaaaatacggatactatgtttcacagacatcttaaaaattgattctacgccgtaaagataattaaatcaacctatagtcaaaaacgataatttataaaaagaatcaatcaacccataaatgagagggaggatatcctattataaatttctttggttaattgaatatcataggatgcgtcgtgcaatttcgcggaatctatttgtatgcctaaagcccttgccaccgtttcctgcttgaaatctgtcatctcatgccgtttgcgcatcaaatgctgggtagacaataccattacgtcgatcgagttcacccagaaccatgagtagaaataattatctccgttctgtacgaagaaggctttcaagaagtgattatcgaaagaggcgttgttgtatccaacgaggaagaacttgtcttttttatcaaatttgtccacgtatttggacagcatgttcacaaatttaacgtacacctctcgcatgggaggataagcttgtatctgttccttggacacgttacaaatacgaagcgcttcttcctctatctcacattggggatgcgggcagacattgaaattaaaagattccttcgtaaccccatcaattacgatctccccacttatttggtggacgccatttctccagtattttatgccggtagtctctaaatcaaaaaaaagtagtttcataaatgctttttggtataggatgcaaaagtaagtttttttattcttaaatgagagaatctataaggttttctccgtttattttattatctttgcgaaagtttgagtctagaatcattatcgacatagttcttctttttatattattattaagcggatctctcctttaatcatcaattctcacgctaagttagtataaacaacgcttcacggaacgtgaggccctagtataaattaaaatcgactgtatggcaaaatacgcatcatttggtaaacgtgaaaacgagaaaaagaaacaagcccgccgagtagagaaacagaacaggaaagaggaaagaaaatcgtccggcaaggcgactagctttgaggatatgatcgcttatgtggatgaaaatgggatgatcacctctgtccctcccgaacttcgtcaaaaagaagagataaatcaggaagatatcttgatctcgactcctaagaaagaggatgtggctcccgttatcttaaggggcagggtagactattttaatgaggcaaaagggttcgggtttatccgtgacttgtcggggacggaaaagtatttctttcacgtgaacaatgttgtggatgatatctccgtgaacgatatcgtgacgttcgaccttgaacgtggcgacagaggcttaagtgccgtgaatgtttgtcttgaaaataaataataatacttacctttgcggccgaaacaattaataaaaatataatatgtctgtcgcaaaagtagatgataatagaaaggtgaccacacatcgcctgatagagatgaagcagcgtggcgagaaaatatccatgcttaccgcctatgattattcgatggcgaaattgatcgatcaagcaggaatggatgtgatcttggtgggagactccgcttctaacgtaatggctggaaacgtgaccactttgccgattacgctcgaccagatgatttaccatggtaaatcggtcatgaaagcggtgaatcgtgcgctggtggtggtagacctgcctttcggtacgtaccaaggaaactctaaagaagccttggcctccgctatccgggtgatgaaagagacgcatgccgattgtatcaagttggaaggcggggctgaggttcgggaatctatcgaacgtatcttgtgtgccggtattccaattatgggacatttaggattgacgccgcaatcgatcaataaattcggtacgtatacggtacgtgcccgtgaagaggccgaggctaagaaactgatcgaggatgcccatttgctagaggagataggttgtttcgccttggtgttggaaaagatcccggcggagttggcggctcgtgtcgcttcggagcttacgatcccggttatcggcattggcgccggtggaggcgtagatggtcaagtgttggttatgcatgatatgctcggtatcaatcaaggcttttctcctcgtttcttacgtcgctacgctaatttaggggaggagattacccgtgccgtacaagcgtacatcgaggacgtgaaatctcaagacttcccgaacgagaaggagcaatattgatttttaaatctaccaaagcatgatatttaccgatgctccgagcgtcaaggtctgtaaggtcttatgatgctcgaagcgatcggtttctttttgggggttggctatgtatgatacgaatcgtgaggggataaaagtataatcgagaaatacccgcacatttagattaggatgcaatatgtatgagaaagaggcgtttgtgctatatcctatattaaacgctttattcgtgtttacgatctctttctcaatcgtttccggtttgccttcctccacgcccaatgctgatattcgggaggctgggctgtaattacatccgattagcagtttcgtgcccaagagaaatcgattggttaccggatacgataggtaggagccgatgtatccgccgatcatgtcgagaggatcggattttagggcgttcacttgataggtcgtaccgggaactgtcggattcgccaagggtttcgtaagggataaaggcatgcttgtcgccgagatgcgtccgccgaagcctatataacgattcatgaaccaagcgccttcaaatccggccgtacttcccggcgatgcttttaattgcacatccggagccagattaaactttgtcggcatcaagctaaaccccatatagattccgaaaaaagagggatttcgctggtaattgaatgtctcgaatcccagatagctatgggtgagacctttgtccttgaagatcaaatccgttagaaaatatccaacctcggtcgataagatcccgattccggcaccaaccattacatccgatagccagtgcttgttattgagcatacgggatacggccgtggcggtcgctaccgtatagcctcctatactataccaagggctacgggtcgtcccgtattctttatgcaacatggtggcggccataaatgccatggccgtgtgcccggaagggaaagaatgattgttcgaaccatccggacgggtgacatttgccgtatgtttcaccgtattgatggttgctcccatgatactggcggtgatggcttcggatacgagcattcgggaccaagagcttcttccttgtacaccgcctatttttaagccaagcatcgctacggcaggtagatattgcaggtaatcgtcgtaatggtatcggaaatttggaatatatgtattgcgcaaactctgaaaatgatcgtcctcatttttgataatcaaaccgctaacgatcaacggtaccccgatataggtcatttggaaaacattgctggtaattatcttgtcggtttgtctttggattcttccccaagtagataaaggcgctagactggaactgtcgttccggtgggtaaaagtgcttgtttgggaaaaagtcgtgccctgaaacattgatatgcaacaaatactatataatatggttaatcttgttttcactaactacttattctttttgtttcatgcagcgaatataataggatcgatttatagtataacaagaatttatgttatttctatgttacatttacgagttggtttcatatctttgtttcccagatatattagaaacagaatacatgagatctcatttgctaataggtgccgcttcgtcgggaagcgggaagactacttttaccttaggattgcttcgtgccttgagaaatcgttctttacgggtgcagccttttaagtgtgggccggattatatagatactcgtcatcataaaatggcggctggttgcgcttccgtgaatttggatggtttcatgatgtcggaagggcatatcaaggatttatatgcccggtatacctcgaatgcggatgtagccgtgaccgaaggggtgatggggctgttcgatggctacgatgccatgcgagggagtagtgcggagatctccggtttattgcggataccgatcgtattggtggtgaacgctaaaagtacggcttattcggtggctcccttgctttatggcttccggaattttcggaaagatctgaatgtcgtgggggcggtatttaatttcgtggcgtcggagagccattattctttcttgagacaagcgtgtgaggatgcgggtgtggaagcgttaggctatctaccgaagtgtgcggatgtagagatcccgagccggcatttggggttgtcgttggatgaggacttttgctttgaggagtttgcggaccggattgcttgcttggtggaggagcatgtggatatagaccgcctgttggcaatcacggctttgccagagcgacagccagttcctcgggttaaggaagtcatgaggactgtttcaaaggcaaacttaaatatagccatcgcccgtgatcccgcttttaatttctcatatgaggaaaatatacatttcttatctactctaggcaagattacctatttcagtccattgagggatgattgtttaccggaggccgattttgtctatttgccgggtggatatcccgagttatatttatcggagttgagcatgaattccgggatgcgtgaatcgattcattcctttgtggaaatggggggcaagttgctggcggaatgtggggggatgatgtatctctgtaaagagattatcggtacggatgggaatgcctatccaatggccggtgtattaccgcaatccaccacgatggagaacatgaagttacgtttagggtatcggactttatgctataagaatgatgtcctacgagggcatgagttccattattcccggatcgtgcctatggaaagcccgctgccttcggtagcgaaagcctttacggcgaaaggaggtcaaacggataccccgctatatcgctacaagaacgtattggcggggtacacgcatttatattggggagatccctgtcggaacgattggtttattgattttctgtatggggaagccccagattgttctcgataaacattttcaatatattgatggcgatctggttgcttcctccttcgggtataattaggtcggcatatcgtttgctaggctctataaattgcaggtgcataggctttagtacccgggtatagcgttccattaccgcttccgccgtgcgtcctctctcgatcatatcccgttggatcacacggataagacgttcgtccgaatctgtatcgacaaatactttcaagtccatcaagtctcgtaattgagggtcgcataaagcgaggatcccttcgatgatgacaacatcacgaggctcgatatgaatggtctcgggcaatcggcagcaggtaagataagaataagtcggctgctcgatgcatttcccctctttcagcaaggtgacttgctctgagaggagcggccaatcaaatgcgtcgggatggtcgaaattaatatattgacgtttctctaccggcacatggctgttatctttgtaataagaatcttgagggagtaatacgacctcgccgggaggtaaactttctatgatcttttttaccactgtagttttcccggaaccagtcccgcccgctatacctataattagcatgatttcttatattaatccatatttatgtttataaatgcaaaggtaagaaatatttatagtggtagtatttcgctattaatagaaaaaacgagataaaaagagctgaattctatgttgtatagcatgtttgtcttaaataaagttaatgagtaagcttttcttgttggaaaattatgctgcataacataaagtctctatatttgcactgtgtttttcatggtattagatttaaggttaacaatgagattggctgtccgtgacggatggccttttcttttatagtaggtcacctcaacaataatgatagttagatgcgttccccattgtattcatgatttattactgtagaaccttcctgttggataaaggtattatcggaagtagcttgtacgcctgtatccaaagatcttttcacggatgtgaaatgatcttttcacaagggtgaaacgatcgtatcacgagcgtgaaaagatctcttcacaggtgtgaaaagatcagatcgtccggagattggctatactatccaccgttcttatcccttgagtgggattacttgcggcacagatcttacgattggttgttacgatattatcacgggcccatcccctttatttgctaaagatgggaatcagataggttagtttcgcggatattatttggctggaagatttagagaaagtgtctcctttacggctattgaacatatcgcccagtgcatagtaataacgaccttccaacaggaaagagcctattccggtgcggagctcgattcccggtccgccgcaaagcccccaatcgaacttcttttggacttccattgtatgttgttcgtccggacggttcgcgttcgggttctcgccattaaggttcgactccgtgctttcgctcagcgcataaccgattttaggccctagattgacgaatacacgcactcgcttgcttccgaaatggatgtgcgtcaagaacggaagttccatatagtttaccgtacggctatatttatattgaggtttctcctcaaacttctcttcccatccatgttgggtaaagttcaattccgcctgtatgcctaaattgggttccgtattccaacgtatcgtcgctcccccgttaaacccaagtttcatcttcgtagggacttttggggcaaaacttacgctagagaaatttaatccgaaggacgctccaaccgcaagctcttgcttaaaagtacttttctgcgcatggcaaatcgataagcttgccatgcacagaaatatcgctacaaatatctttttcgtcatcatatcaattatcttacctcaccgcgggttaccgtataatcattcttgtaatgtacaataaacaagttcgtattgataaaaccgccccaattattcactctatggaaatcgaatccggtctggatgctcttataatggatcttgtctaaattattctcgaagttcgagccatatttattgatggcgcctaggaaatacatacccgtgtcaaagcctaggattccatatttcgggaatgtgttgattaaattcttgctataccagtttttataatcggaataaaagctatggacttccggagataagttgtccgcatagaaattactatagatataggtgttcaatgcgtagaagtcctccagacactctcttgtataggtctgccattccggataaccgaataggttgaccatataaggctctttctcctcctctttcaactcggaaagcatacggagcggtgccttgatcttattcaccgcatctaaggaggcggaggttggcaataccacattccgcttgtcccttaccatggctgcctctatatccgtggcgaaagtatcccctttataagttacttccttgaacgggatatcgcgttgctgcatctccgtcttgaaggctttgataaattccggcttttcttctttatcctttatattgacaagtatgatattgtaatccgagaataaatcgcatccggcttgtgccgccttggagtataaataggaatgaggtgtgtttacttgataaacattcgcgtttgacaagacatcatcattcttggaggtgaaagggatcacgtatttgatattatgcttttgggcaaaatcagcgatcaatccgatttggtcgttctgtacggcgccaatgatcaaattagcgtttgataacgcatcttctttcaatatctccttgactttcttcgtaccgtttccagtatcatataccgatagctcgatagaggttcccatatttcgcaagctgtcgaccgccaatagcaatccctcgtaatattccacgaaacgggaggtcgcggatgattgcgttgtctcgttcgtcatgaacggcaacaataaggcgacttggatacggttcaccttctttatatctttaggcgtagagaggagggcgttcacctcacgctcttccggctgtcttatgttttgggtgatcacttcttcactggctaccggtatcttgataaccatgcccgcttttactccgtttttcagctcggggttgagtcttaaaagctccgcgctggaaatatcgaacttccggcagatacggtacatggtctcttttttctgtatggtatattccatttccttctgtacggtctttttttccgtagtaggcaaggtttccagtcgtgtcggcgggatccggatattcttgccaatcgtaaaggtcgatgtggagagacctggattggcggcgataatatccgtggcgggcactgaatatttaatggataaagagtacaaggtctctttcggctggatcgtatggtatgtatagttatctgctttgccggaaggtgcgatagcggagtccttctgcgggattcttaacgtagaaccggccttgatcccttctttactttccggattcaaccgataaatatcctctacgcttacgccatacatggtcgctatggcgtatacggtttgtccgcgttcgatggtatgataaaatatatcgctcccttgttcgttagtaaaaataacttgcttattattcttttgggaataaacggttacgctcgataaacttaaaaagaacgtcaatgcgtatatactaatcttgttcatttgctgttcggagtattttgtgacaaagatagtgaattttgcttatcatgctacgtatgtccttttatttccctaattttggaaccgtaatttttagactatatatgctaaagaaggaattaagaaagatactgttatcgctaagttttgtgtttgtagcggctgtctcgtgtgcccagtatgtggtgacgggaggaagtggtagcccgatgaaagccacgcagagttccggcgattccgccgagcgacttgaggtctacttggtgtatggaatggataacgtgacgattagttatacctcatcatcttcttcttcgcatcaatggtatcgttataaaaccaagcgattggaggccgagaaggtggcctccacccaaaatggaactacttccaccattcggaatgtagaggagggatatggctattttgtcgaggaaggagccgtatctcgttacgtctggatcgttgattacagcaaatacaccttaaacatatccaacctgcatgtctccgataatagcgatccatgtagcggattggtcttggctgggacaggtacgatccaacctatttattattattggccgaatacgggaacaagacgtgaactgtctcgccaatttgatgttatttataatacattagaatataattcggataaaaaagaatatacctctaaacaagagacggcggtcatcgagggcaatttgttcggtaaatccattcccgctccttggtgtgatacggagatctgtgtgaaaggcgattatttcgctcgtcattttggaaaggaggttacgctttgtatcgatgaatatcaggccgctgcggtagatgctcatatagacacgttgctgattgagcaagaggccccgaatatgaatacgacgaagagcggttattgcgctcccgccactgttcaattttcggctatcgcgaatgcgccgacagccgccctgtttaattggaaaatctatcggcaaggggaagaagataatccggttgttcgttttacgggtgaggaggtggattatacgttcaaccaatccgggacttttatcatcaagttggaagtaagcgaccaaagcactacttgcagcacggaagatgaggttcagattgatatctcggagtcttatctgatgataccgaacgcattctccccgggtaccacgcccggaattaatgatgagttccgggttgcctataagtcgttggtgaaatttaaggcatggatatttaatcgctggggcctacagatgtattactggacagatccggcccaaggatgggatggaaagaagggcggtaaatacgttcagccgggtgtgtatttttatgtgatagaagccgaaggttccgatggcattaagtacaaggaaaaaggcgatataaacattcttagacctaaaacaattcaagatgaaaatgagaatatccaagaataatttagctagttttttatgtggaggcgtcgtttgcttgaccgcatgtatctcgatgagttcgaatgacgtggaaaaagtgatagagagccgtccggttgtctcatccatgaccctgtcgccggatgttccgtcctcggttcctttttgtgggaaactaatcgatattacccgctatgatatgcgggaagcctatgaccgtgaattgagtagctttacttatttccattctacgacgatgcttctgatcaagcgggcgaaccgttatttcccggtgatcgagccgatcttgaaggcgaacggcattcccgatgatttcaaatatctagcggtgatagaaagccatttggacccccgtgtatcctctccggctcgtgctgtcgggatgtggcaattactggagggcacggcaagggagtatggtttgacaatcaccccgacggtcgacgagcgttgccatgtggagaaagcgaccggggcggcttgccgctatttgaaggctgcctataagaaatatggagattgggcggcggtagccgcttcttataatggcggcatgggacgtatatccggtgagctggtcaaacaagatgcggattcctcctttgatctctggctggtggaggagactacccgttatatttatcgaatcatggcgatcaagcaaattttcgagaatccgtcgaagtacggttttgtgcttcgtgcccgtgacctgtataagccgatccctaccgtagacgtggctgtaagccaagatatacagaatctgtcggctttcgctaaagagcatgggatcacttatgcggacttgaaacgttttaatccttggctccgtgatcggaagttggtgacaggtgggaagacctataaattaagcattcctcaagaaaaggatatgtattataagaccccgaatacggaagtatacgattcggcttgggtcgtgtcggagaattgatccgatttttattgatacaaaaaataaagtgtttcatttggatggtataactgcccatcgtaatgaaacactttttctatactacttctcgtttaaacggattcagtctattagtcaacgatcgttacacggtgaccgttgaacacgttcaatccgagtttattcattacatacttaatagcaagctgtgcctttacagagttaccagcttggtcaataggaggagcgaatgcggaaataccgaattgtccgggaagtacacccatgacaccaccgcctacgccagtttttgcgggaataccggaagtgtacaaccaatcaccggtgtgttcataaaaacctacggtagagatcatggaagtgatcttcggagataattctgcatcgaatacttgtttctttgtcacaggattgagacctaaatttgcgaccgtagcggcagcgacagatagttgcttagccgtgatacccaaagaacattgacgggtatacagatccaaagacatatccggatcgtcataaatgcgattgtaattctttagcaaccaagcgatggagcggttattgaagttcgttgcggactcggatttatagagttcgtcgatcaactgcggtgcgcttccgcacaaatccgtgatattggctacgatagcatcccacttctgtttggaatcaccgacaggcttcaccatactacaagccgtgatagcgccggcatttaccaatggggtagaaggatggtcgttttccaataagatagcgatgatggagttaaatggcaatccggtagcgtcggcaccaatcttctccaataattctttcgctccgtattggcgcagtaccaagatagcggtgtgtactttcgatacggattcaataccgaaacgatattcggaatctcccacctcgatggtttgtccgtttaaaaggcaaatactgattccgaatagatttttattgatattcgccagataaggaatgtaatcggcattcttaccatccgtatttgtcttgtaaagatcgtaagcctgttgagctacttccttaatttgggcgatcgttatttttttgtccatatatgaattggattaaagaaggcgtgtatgaaaacactgatagccctttcatgcacgccttgatgaattttgtttttatttcttagcgttgctcattgcggtgtgagtaaataccttacccttaaccggaacgtttttgtcttgagcgatgcgagtaggagtcggatattcaagtttctccaatgcctctacagcgttcttgatatcacctaataacatatcggccatatcgcggctgaaaccttgacgaactacgacacgcataaccacgtagttatccagcttcttcggtagtgtatacgctggaaccatccaaccgctttgttgcaatttatcttgcaaatcgtaaagtgtccatttggcgttcttagcgtaatccggtttcatgtaccaaataaacaatggattcacaacctcgttgctgtaattaacgaatggggccatcttaccgatttcttggtggatgtatttcgtgatttccatactgttatattggatttgtttgtagccctcgaatccgagacgaataaactgatagtattgtccgaggatttgtgcggcaggacgagagaagttcaaaccaacctgagtgatattcgctccaagatagtttacgctgaatgccatttcttccggcaaatatttcttgtctttccaaacaacccaacccaatcccgggtaaaccaatccgaatttatgtccggatgtgctgatagaaagaacccatttcaaacggaagtcccattttgtctccgggcttaagaacggaaggataaaaccaccgctggcggcatctacgtggataggtatatcataaccggtcttggcattgtatgcgtcgagcgctttgtccaaggcttctacgtcatcgttcagtcctgtccatgttacaccttggataggaacgatacaaatcgtgttctcgtcacacatcttaagcgcttcttccggatcaagtgtcgtcttgtctaaagtcaagggaacttcacgcatttcgatttgccatagctgggcgaatttctcccatacgacttggaagccagtagagatcacgaaattaggcttgtcagttggtttaccttgtgcttgtctctttttgcgccaacgtaaccaagcggctacaccacctagcatacaagcctctgaagaaccgatagccaaggctccggttttccatttttcttgctcgggagaattccaaagactcgccatgatattaatacatttggcgttcataacagcgattctcggatactctgtttcgtcaatatagttgatgttgatagcttcgttcatcaattttgtcgcgtactcgtccatatacgtagtaacgaatgtagctaggttcaagcgaggctgtgtttgtgcgaaagtctcgtctttaaccatttgataagcgatctccggggttgtagggccatcaggaatcttatctactggagagggtgtcaacatcacttctgagccaaaaatcgctgttttggcatcgccatttctgaaatttgagtctttcatttttctttagtttttttgttaataaaatgatttgagtcaatggaatactgcttccactgagcgtttatgccaaaacagattatggattggaatgttttttggatttacattatttggggtttattagcgatacaagtccagtcctcttggaaagagcgaaaatgatgaactttcacataaaatgtttgttttgattagataaaaacgtaaaactaaatctttatgagaatacagacaggccggggcacaattccccttataactctggtagggatatggtctatctccgctttaaatgcattaccgggtttagcggtttctccgatattagggaaactttccgttatttttcctcattctacggaactggatattcagatgctttcctctttgccatcgttattgataattccatttattatattgtcgggtaaattaacggagaaagtaaatgagatacgtctattgcaattaggcttggtgatctttgccctaagtggtattctatacttactctctaataagatgtggcagttgatagcggtgagcgccttaatgggaatcggatctggcttgatcgtacccttatcgaccggtttgatttctcgtttctttatcgggaaataccggacgaagcaatttggtttaagttctgctattacaaatgtaacgttggtattagccacgatcttaacgggatatctggcggaggtgaattggcatttaccgtttgccgtttatctattgcccttgatttccatcgtactttccgtatacttgaaaaggagtatggagaatgagccggcgatcgtatcgaaatcagaagtgaaagcccctgttacggcagatcccgtcacggttccgggtaaatatggtgtggatataaagcatctggtacaaatcatgtgtttttatggattggctacgtatttagtgattatagtcagctttaacttaccgtttttaatgaaggaatataagtttacaagcggtaattccggattaatgatatcattgtttttcttggctattatggctcccggttttatcttgaatcagatcgttgatttatttaagcaaaagacaaaatttgtcagtctattggcgatcgctttagggatggccttgattttgatatctcgtacggaatggctaattggattgggatgtatttttatcggtttcggatatggtgttatccagccaatcgcttatgataaaacgactcgtacggccattcctgagaaagttacattggcattagctttcgtgatggcgatgaattatttggcgatattactttgtccgtttattatcgatttcttccagtctatgctccatgtcaagagccagcaattcgcgtttatttttaatctctgtattgcgctggtcgctacgatctgggcttatgtaaaacgagactcgttccttttcaacgataaaatatgatttacgaatataaaactaaaaaacgatagacagtgaaaaataagaaaacagaagctaatattagcatggtggtctcaaaaactttcagtggattgaatatgaacgccttgaaatacttgcttcccttatggatgagcccgttgacgggcgcttctttccgatgcgtgtttgcggccgtggcgttttgggtgatcggctggtttatgaaaccggaggtttctacgacgaaagataaggtgtggctattcttactaggcgctatcggtatctatggttttatgtttctttatttagtggggcttagtaagacaacgccggtctcgagttctattttcacgagcttgcaaccgatctgggtatttttgattatggtattcttttataaggaaaaggctacttggatgaaaatactcggtatcttgattggtttatccggggccttggtttgcatcttgacccagcaaagcgacgatttagcggcggacgcttttaatggaaatatgctatgtctggctagctccgtgttttatgccgtgtatttggtcttaagccagcggatcttacaaaaagtagggacgatgacgatgcttcgatatacattcacgggcgccgctttctccagtctattgattttgccgatagaaggctttcatgctcctttattctcggagccatttcattggtggccttttgccgtattgatgtttgtgcttattttccctacggtaatcagttatctgttgattcctatcggattgaagtatttgaaaactacgttggtggctatttatggctatctgatcttgatcgtggcaacgattacatccctattgatcgggcaagaccgtttcagttggacacagacgttcgccattatctgtatttgcgccggggtttatctggttgagatagcggaaggaaaagagaaaaagacagtcaaggtttgacttattaaatatgaactattaaattgtagcgttatggataaaaaacaagaaaagaaaatctggaactctcaacttgcgattgagaatccgaagaatgataggatcgctgttatttactctgtaaaagttagtagtgtacgaatcctagagaaacctcgtaatccgaaaagagggaagacccgttgacaatcatcatcccctattctatatataaatatatgaataggggatgactgtctatttattctccacttccatgctcatgatataatcgttcatgaaatagccgtttcctatatgatggtcccgtgtgcctatttcccgtaatcccatatgtctgtagaagcctatggcgggattgtaacggtttacgtataattctatagtgaaaggcccggtatgtacctccttcaaataattaataccttgttcgatgataaaacgcccgattcccgtgccatgcatttccggtagggaatagatcttttgaaaattgtacgtgttttcacctgttttctctatggataaatagcctgccggcatatcgtccgccaatataataaaatattgatgatgtaactcttccatttgtttaagaatgttatccggagcgtacatcatatcgaacatataatccaattgctctttagaaagtatctttccatacgtgttctcccaaatgcgtgaggcaagatcatgaataagagaacgatcatcaatagtcgcttttctaatcgtaaacatgttaattttgtattttgactcacaaagatacaaatagacgaacaaaaatacaatatagacgaatgtaaatagaattttacttgactagtgttattttttagcttgatttcacacttattttcatgttaatccgcgaaaaataataactttgtgggcgtttactattgaaaaatacaattcaaatacataataggaaatggatacaaagattcaggaactaacagacaagatctacaaggaaggtgtagagaaggggaacgaagaagcggggcgtataatcgccgaggccaatgctcaaaaggatacgattcttaaagatgcggaagcggaagcgaaacgtatcgtagcggctgctgagaaacaagctgccgagttgaagaagaatacggaagccgaattgaaattgttcgccacccagtctgtcgaggcattaaagagcgaggtgacaaaccttatcactggtgatatcgctagttcgaatgtgaaagcggcgttgatggatcccgcctatatgcagaaagtgatccttgagcttgtgaaaagctggcccgctaatgagttcttgactatccaagcttctgattccgatggcttgaaggcgtattttgaggccaatgccaaaggcttgctagagaaagggtataagatcgagaaggtaagcggaaagaaagcgtctttctctattatcccggcggatgggtcttataaagtgacgtttggcgaagacgagttcatcgagttctttaaagagttcttgcgtccgcaattagtagaaatgctgttctgatatgagtaagtattactacttaatctccggacttcctaacatagcgttggatgatagtaaactagcctattcggtctgtgagttccggacggaaatagaggatatgctatcttctaaggataaaaagctgattgatttattttatttgaaatatgataatataaatctgctggctcacgctaaaagaccggactccgatccggatcaaagaggaagaataacgtatgatgagttcaatactttatataaagcgttgaaggatgaggaaaaaattcccaaaaatgataatctcccgccttatttcgtggacttttttaaactgtatctagccgaagaggctaaggacaccaaaagtgagaaagaatatatatcatgggaagaccgcttggctgcgttatattatgaatatgccatgaaatgtgggaataagttcgtggccgattggttcgagcttaacctgaatatcaacaatgttcttactgcgatcacttgccgtaaatatggatttgataaggccaattatatcgtggggcataatgagatagcagaaaatatccgtacgtcgaacgctcgtgatttcggcttgggcgattccgtggaatatttgcccgagttacaacgcatcgccgaagagaccgatctgatcgttcgtgagaagaaaatcgatcttttgaaatggaaatggctggacgataataccttcttcaagacgttcgacatagagagtgtattcgcttatttattgaaattggagatgatagagcgctgggtaaccttggataaggcgagaggcgagaagactttccgtgaattggtaggcgccatgaagatgggtagtgagaatgcgttggaagaatttaaaagaaacaatataaaataaattatggctacgaaaggaattgtaaaaggaatcgtatccaacctagtaaccgtagaggtggatggtccggtttctcagaatgagatctgttacatttctgtcggaggcgtgaagctgatgtcggaagtaatcaaggtgataggtaagaatgcctttgtacaagtatttgagagcacacgtggtatgcgtgtcggcgacgaggctgaattccaagggcatatgttggaagttacgctgggtccgggtatgttgtcccgcaactatgacggtttgcagaacgacttggacaagatggaaggtgtattcttgaaacgtggcgattatacgtttgcgttggacaatgataagaagtgggatttcaagcctctggctaaagcgggcgataccgtgagtgccggtgattggctgggagaggtggacgagaatttccaacctcataagattatggtcccctttaagttcgagggatcttatactgtgaaatcggtggttccagccggacaatataccatcaatgatacgatggctgtccttacggacgaaaatggcacggacgtaaacgtgacgatgatccagaaatggccggtaaagaaagccatcacttgttataaggaaaagccccgtccattcaaattgctggagacgggcgttcgtacgatcgataccgtgaacccgatcgttgagggtggtaccggatttatccccggtccgttcggtacgggcaagacggtgcttcagcacgctatctctaaacaagcggaagcggatatcgtgattatcgccgcctgcggtgagcgtgcgaatgaggtcgtagaggtatttacggagttcccggaattggtagacccgcatacgggacgtaaattgatggaacgtacgatcattatcgccaatacatctaacatgccggtagccgctcgtgaggcatccgtatatacggcgatgaccatcgccgagtattatcgcagcatgggcttgaaggttctgttgatggccgactctacttcccgctgggcacaggctttgcgtgagatgtccaaccgtttggaggagttgcccggaccggatgccttcccgatggacttgtccgctatcgtggcgaacttctacgctcgtgcgggattcgtccatttgaaaaacaacgctacaggttccgtcactttcatcggtacggtatcgccggccggtggtaacttgaaggagccggtgaccgagaatacgaagaaggtggcccgttgtttctatgccttggagcaggagcgtgccgaccgtaaacgttatccggccgtaaacccgatcgagagttattccaagtatatcgagtatccggagtttcaggaatacatcgctaaacatatctccccggaatggatcgagaaagtaaacgagatcaagacccgtatgttgcgtggtaaggagatctccgagcaaatcaatatcttgggtgatgatggtgtgcctgtcgagtatcacgttacattctggaagtccgagttgatcgacttcgtgatcttgcaacaggatgctttcgatgccatcgatgcggttactccgttgcaacgtcaggaatttatgctggatagagtcgtaaatgtttgccgttcagagtttaagtttgataacttccttgaggttatggactacttcaagaagatgatcaacatctttaagcagatgaactattcggaatacgagagtgaccaattcaagaagtttaatacggaattggatgaacttttgaaggagagaatcgaaaattaaaagagttatggcaacaaaagcatttcaaaaaatatatacgaagattacccagatcacaaaagctacctgttcgctgaaagcaacgggagttgggtatgatgagttggcctctgtagacggaaagctggctcaggtggtaaagattatcggcgacgaggtgacgttgcaggtattctccggaacggaaggtatccgtacgaatgccgaggtggtattcatggggaaggccccttccttgaaagtaggtgaccagttagccggacgtttcttcaacgcttatggcgagcctatcgatggcggtccgatccccgagggacgtgaggtcgagatcggtggtccgtccgtgaacccggtacgtcgtaaacaaccctctgaattaatcgctacgggtatcgccggtatcgacttgaataataccttggtaaccggtcagaagatcccgttcttcgccgaccccgaccagcctttcaaccaagttatggcgatggtagccttgcgtgcgaagtccgataagattatcttgggaggtatgggtatgacgaacgacgactacctgttctttaagaatacatttagtaacgccggtgccctagaccgtatcgttagttttatcaacacgaccgaggacccgtccgtagagcgtatcttgatcccggatatggcgttgagcgccgctgagtatttcgccgtggagaagaatgagaaggtcttggtattgcttaccgatatgaccaactacgccgatgccttggcgatcgtatcaaaccgtatggaccagatcccgtctaaggactctatgccgggttccttgtattcggatttggcgaagatttacgagaaagccgttcaattcccggcgggaggttccatcacgattatcgccgtaacgaccttatccggtggtgatatcacgcatgccgtacctgataatacgggttatatcacggaaggtcagttgtatttgcgtcgtgatagcgatgtgggtaaggtcatcgtcgatccgttccgaagcttgtctcgtttgaaacagctggtaaccggaaagaagacccgtgaggatcatccacaggtaatgaacgccgccgtacgtttgtatgccgatgccgccaacgctaagaccaagctggagaatggtttcgacttgaccgactacgacaaccgtaccttgtctttcgccaaggattattcttctaagctgttggctatcgacgtaaacttggatacgacggagatgctggacgtagcttggggattgttcgctagatatttcagcccggaggaggtaaatatcaaacaaggattggttgataagtactggaagtaaattaaataaacatggcaataaagtttcaatataataaaacctctcttcagcaattggaaaagcaactgaagatgcgtgaacgctccctgcctacgatcaagagcaaggagagcgccctgcgtatcgaggtgaagcggaccaaggacgaagtgaataaattggaacttcagctagaacgagagattcagagttacgagaatatggtggctttgtggaacgagttcaatccggagctgatctccgtgaaggacgttacgctctccacgaagaagatcgccggcgtgatcgtcccgttattggacgagatcaagttcgagatcggacactatagtctctttaatgcccccgcatggtatacggatggtatcgagttgctgaaaaagctggctcgtaccggtatcgaggcggagttctcgggcatgaagctggagttgttggagcatgctaggaaaaagaccactcagaaggtgaacctgtttgagaaggtacagattccgggttataaggatgcgatccgtaaggtgaaacggtttatggaagacgaggagagtctttctaagtcctcacagaagatcatgagagccaatcaggagaaacgtaaggcaaaagaagaaaaagaggaggccgaggtatgatagtaaagatgagtaaatatgcctttatggtgtaccataaggagtatgatacgttcctttctacgcttcgtgacttaggtgtcgtccatatcaaggagaaaaactccgtgatggataacgagaggttgcaagagcttctggctgagcgtaaacagatcaatacgctgatgcgttactttaagaacctccatgcggcggagaaagacgttaagtttgccccggcccgtgagttgacgaaagaggaaggcttgaagttggtgcgtaagatagaggaattgcaagataagaaagcgcaattgatcgcttccaagcaatcgatcgagaaggatctggcttatatggaaatatggggtgagttcagttatcagaatatcaaccgtctgaaaagagtgggatacgatgttacgttctttacctgtcctaccgctaagtacgagccggaatggggtgtactgtataacgccattctgatcaataatttccaatcggtaacgtattttatcacgattaccaaggaaggtaccttgatcgatatagacgctgaacgtccgaagatgccggttcaaggattggcgaagttgcgtgcccgtctggatcaacgtaccaaggatatccagaatgtggaggatgagctgaaacatcgtgccgtggaggattataaaacgttggaggaattcgataagaacctgcaggacgagtttaatctttctaatgcgttagtgcagacagaccggcaagcgggtgataagctcatgttgttggaaggttgggtgccgacggaaaacgctccggccttggagcacgaactggataagcaaggttatttcttccagcaattagagatcgaggatggggataaggtgcctatcaagttacggaataataaattcagtaagctgtacgagcctatcacgaagatgttctccttgcctaattacggtgaacttgatccgaccccgttgttcgccccgttctttatgctgttcttcggactttgtttcggcgatggcggatacggtttgttggtcatgatcgcttgtacgatcttgaagaagaaggtgaacccggatttcaagccttatttgaccttgttccagtatttaggtttcgccgccttattggtgggtacttgtacgggatctttcttcggagtggccttggcggatatcccggctttgtcaaagatcaagaactactttgtgaatagcgacaacttgatgacattctctattgtcatcggtttggtacagatcatattcggtaaatgtgtcgctgcttacaagatcaagatacagaaaggaacgaaacacagtatcgctccgttcgcttgggtgttcgtgatcatatccttggcattggcgttcggacttccgatgttgaacgttcacttgccgaacgctgtcgttatggtatgttacggaatcgccatcttgggtctggttgtcgcttatttgtacaatacaccgggcaagaacgtattcttgaactttggtaccggactttggaacacgtacaatatggcctccggattgctgggtgatacgttatcatacattcgtttgttcgctatcggtctgaccggttccatcttgggtggcgtatttaatacgttggcggttacgatgacagacggtatgaatatcgtggcacgtgcgatctgtatgttgttgatcttgttagtgggtcactccatcaatatcgctctttgtacgatcagctccttggtacacccgcttcgtttgatcttcgtggaatattacaagaacgcagagttcgaaggtggaggtaaggcttatgagccattcagaaaagcataacaattaaacgagaaaataaaacaataaaagaataatttaaaaacacattttattatggaaccaattttattagcttatgtaggtattgcgttgatgacaggtttaacttttatcggcagtagttatggtgttacgatcgcaggtaatgcggtggtaggtgcgatgaagaaaaatccggatgctctgggtacgtacatcgctttaagtgcgttgccttcttcacagggtttgtatggattcgtgggctactttatgatgcagaagttcttggtcgctgatatttccatgttggccgctacggctgttttcggcgctggtttagtgttaggtttcgctggtttttactcttcaatccgccaagctcaagtttgtgcgaatggtatcgctggtgttggtgccggacacaacgtattcggtgctacgatggtaatggccgtattccctgagttatacgctatcttggccttattggttgtgatcttgattggcggaacgattcctgtcgcctaatcattcaaacatctggatataatagaggccgtcccggacatttccggggcggctttttcgtaaacaagaaaagctatgaaacgacttacggccaagaagaagagattcttctctttcttgagataggtaaaggggatctctttttagatacatttgctcattcatttacgaacagttaaaatagggatatggatgagaaaggatttgtagaaggtatgagggagtatatagcccagttgaatcgagaaaagcgatattcctcggctaagagttatcaagacgcattaaactcctttataaggtatagcggaaccgactgtatagcttactcggctattaataaggataatcttcgccggtacgaggcttatttattggagaacggctgtatgcgcaatacgatttccacttatatgcggcgtttgcgttgtatctataacaaagcggtggagaacggtaaggcggaatttattcccactttattcaaggggatttttacgggtgtggaaagtaagcgtaagaagtccttgcctatcgaggatttacaccgtctgatgacagtcccggtggaggatgggaagcagagaaagacacagttggcgctttgcttgatgtttctgtttgggggtatgtctttcgttgactttgcccacttgaagaccggtaatatcaaaaacggtatattagattacaaccgtcagaagaccgggacaccgatgagactggagatcttggagacagccgagacaatgtataaggaattgtcaggagagaaagtgcgagattccggatatttatttccctttctgagtggcaccagagaggggcgtgaggaatacctcgaatacaatgcggcactatttcgatttaaccggaatttaaaagcgttgaaagaatttgcgggaattacctcggatgtcacctcttatacgattcgccattcttttgccatgacattaaaagaacaaaatgtcccgattgaaatgatcagcgaactattggggcataaatctatcaagacaacacaaatttatttaaggagtttctctttagggaaaatgacggaggttaatagcgcctgctttggcggtgtctataattatgaatctcaagcggggtgaggctacttggagagtagcgtattctttcacggcgcaaatgtaataaaaaatagctaaaaacaagcgaatagatccgcttgtttgttcattattggtgtttgaccctctctattctttgatttttccattttttcctagacgtatagacacggtgatgcgggcgaaacgactccttgttttcggtatcattccgccatgtctcataacctgtgtgtatccctgtagagatggggcgtgccccgtctcatcccttcaaaatggtatttaaaattactcccatacggtgggagacggagcacgctccgtctctacaaccgggtaataaccattctcctacctttttacgctactctccaagtagcctaagatttcgagagatggtaattttcagtaatgccatatttgaaaatataaaacgctgtttatcaagatgatataaatgattcttggtagggctctgaattgccatggggtctgttttcgggccatgggataaccactagaaaagataatcatagagatggatatattgacaagcaagtgctcggataggttcatggcgcatgttcgtaagcgacgtgatcaagaggctgtccgctggtacgtgctcacgcttcctaccgccggtggcgggcgtgacaagatcagcccctcgaagggactggacgttgagctttcccgccgcgagcgtcgtggggaggccttgttcgagtatttctccccctcgtatgtagaggcgaggaaggtgggcggcaagatggtcaacacgaaacggcccctgctgtacaactacgtgttcatccacgcctcggagaacgagatctttagtctgaagcgtacgcttcctctgtacaatttcctaccccgggtttcctcgggtggacagtcttactttccctacctctcggatcgtgagatggagaccttacgttgggtcgcggcgtcttactccaacgagcttccggtgtacgtgcctgatagtggccacctgttgaaaggcgaccgtgtgcgtatcacctccggtccgtttgccgacatggaggccgaggtggtggtacagccgggcggtggccataaggacgtgatggtgcgtatcctcgattgcatgtgggttcccttgttcgaggtgagagctggggagtatgagttgatcgagttgaacacggggggcaagcacgtgtatacccatttggacaacgaccgtctgtcggattaatattaatactaaagtaataaattaagaggtccgtaagtacctccgtgaggatggagtacggataaagaaacaagtctccggcaggcgtaagctttgctggggacttcgtattttgcgaccttatttatgtgtaactaatgaaaaaagaactgtctaataacgtgaaagatggggcctttttgtatttttgcggaaattaggagtaatagtagtatcaaaaataagctcaaacaattaatgtcaaactcaaaaatctcagcagccgcatttgcggacacaaaacctcattatgaccttcttgatggattgagaggtgtcgcagcgttaatggttatattttatcatgtattcgaagcctttgctacgagtcccattgatcaacaatttaatcacggttatttagccgttgatttcttctttatcctgtccgggttcgtgattggttatgcttatgacgaccggtggaaaaccatgacaacaaaggattttatcaaacgtcgattgatccgtttgcatccgatggttgtccttggagccgttttgggagttatcgcgttttatatacaagggtgtgagaagtgggatggtacgcatgtctctatatccatggtgatgctagctttgcttatcaacctttttttgataccggctgtacccggttccgggcctgagatccgtggaaatggtgagatgtttcctttgaatggtcctagttggtctttgttcttcgagtatatcggaaatattatgtatgctttgtttattcgtcggatgtcaacgaaggcgcttacggcacttattgtcttggcgggaatcggattggcttcgttcgctatattcaatttttccggtgcggggcacctaggtgtggggtggacgatggaagagtacaatttgatcggtggctttttacgagtgttattttctttctcgatgggattgttgatgtcgcgcgtttttaagcccattcatgtcaaaggtgctttttggatctgtagcctggcgatcgtcgttttactctccatgccctatgccggtaatggtgagaccttatggatgaacggtatctatgattccgtatgcgcgatcctgatattccctatgcttgtttatctgggggcttccgggaagacaaccgataagcattccgcccgtatttgtaaattcttgggagatatctcttatcctttgtatatggtacattaccctcttatatacttgtattttgggtgggtgaagaaggagaaccttacatttgcggaagcatggccggaagcgttggcattagtgatcggaagtatagtattggcttacattagtttgaaactttatgacgagccagttcgcagatatttgacaaagcgctttttacaggtacgcaaataacctgacataaccgtatgtgccacccaacacatacggtgtatcggtgaataagcggatcagaatgggtattagtagcgatttgcccattctaagattgtcggactttcgacatcaaccccgaactctttggcttttctcaagatattatgagctaattccggcttttgcagatcggtagcgtatcgaaaataggattcggccgcccgtacgtgtgtggcgtccggcataggatattttcgttcttcgggtaatccgaaatcagagtcgttcaactctttgcgttcctccgtgtcaagtcggtcggaaccttgttctctttctctttccatcgtgataattttttaatgatctgtttatgaaacgtttcgatggaaacaatcacttctcgctaaaaagtgttgggaaagaattaatgtttatcaaatagatctgattcataaagaaaacatgcctcgcaaagctcataagaacacatctttagtttcatccttagaatcggaaacggattgccttgctcatctgtctcatccgtctttatccgctatacgatctaagaggatagacacatgtctgccgtccatcaagccatgatgagccgttacggagatagggagcatccgatgcccgttctgctcgatcagctttccggtggagatgcgggtagcggaatcgcctgtacggaaagaggaagcgtgtttcatctccgtgaaggcgatccacgggaccggggagaaacggactaggtcttgccggtcagattccctatctttgcaaaggcctgtgagagcttgcacacgttcgatctctttctgtgcgttttgaaggaacagttgcctgtccggtgtatattcgaagaagccgaagccgaatgttccgtcttctcgcccaatcgttgttcccacgtggattcggtcgaagcagacagggatgttgtcgatgatccggtaccggaactcttccacctcattaacggctgtcataatcttatgtaaggagtagaggaaaaaagaggcatgatccgctttcgcctctttatagatggaggtcacgtctatctgggtggtcagtccaaagaaagggtcgtccatagaaccgaaaaacaggaaatgttctttccggttccaatgctctaggtcaataggatgcttcatgattctttatttgttgggtttactattttgtggaaagcgatgcgttccgtaccatttgcgatgtaaatgataccgcattgcttgaagccatgctttttcaataagttttgcatgacaatattatcccggtgtgtatcgatacggatattatcgcaatgagcgaatgcccattttagacattcggtcgagatccccttttgcttaccgttggaggccatgcgatggatcacggcataaggttcatcgttcagccattcgccttcatagatctttaggtaagtagggtcgattccctcgatgtaacaaaaggtccccactaactcgccctgctcattttcgcatacgaaactatggctggccttgatctcgttggagatcaattccttggaaggatatccgttgatccattgattcccgttgccatgctcttgcatgaacctgcgtgcataatcgtacatagccattacctcggccagatcttcttgtcgtgtttgtctgatattcatgatcggtagaaaaagttatcccgcaaaagtagtatattattgttatctttgcgaatctagtcgaaaaatatataaaccaattaaatcaaaatatcatggaaccattaaaaattgctaccgtgcagttcgagacacgggataacgataaagtgtataatctttctatcatccgggagatgtgccggaaagcgtcggtagagggagcggatgtagtggcttttcacgaatgctcggtttgtggatatacgtttgccaaggacttgtctcgcgaggaattgttggctattgccgaaccgatccccacgggggagagtacgcaagccttgatcgccatcgccaaagagtttggcgtcacgctactggccggattctttgagcggcatggggatcgtatctataaagcgcaagtttgcgtggatggcaatggcttgaaggcaaagtaccgcaagctacatccgtttattaatccgaatatcttgccgggcgatcaatatgtggtttttgagatcaagggatggaaatgtggcatattgatttgctacgataataatatcatagagaatgtccgtgccacggccttattaggggcggatatcattttcatgcctcacgtgacgatgtgtaccccttcccctcgccccggggctggtttgataaatcctgtgttatgggagaaccgggcaaacgacccgacttccttgcgacaggagttcgatggcctgaagggacgtgcttggcttatgaaatggcttcccgctagggcgtacgacaatgcggtatatgtggtattctccaatccgatcgggcgtgattataatgagatcaagaacggttgctcgatgattctggatcctttcggcgatatcgtggcggaatgccgtaaactgggtgatgatttcgtgatcgctacggctatccctgagaaattgagacaggctggaggatatcgttaccgaaatgcccgtcgtccggaactttatgcggatattatcggccaaccgcatgagtccaatcaaaaggtagcatggttaacagaaacaacaaatagcaaataaatagtatgcaacaaacaacaatctctaagtcacctcgtgtagaggtggtggatgcgctacgtggtttcgctgtcttggcaatcttattagtgcataatgtggaacattttatctatccggtctatccggacccggctacgctgccgggatggttgaacgtattgaatgaaggcgtgtttacggtggtattcgctttgtttgccgggaaatcgtattctatctttgccttgttatttggttttaccttttatatacagtattcgaaccagcaggcgaagggaaaagacttcggttaccgcttcctttggagattactgctgttgacgatcttcgctacgttgaacgccgctttttatccggcaggcgatgttttgctgctgtatgcgatcgtgggcgttgttttgtttatcgtgcgtaaatggagcgataaggctgtcttgataacggctattatctttttattgcagccggtggagtggtatcattatatcgctagcctgtttaatccggattaccaattacccaatttaggagtaggggagatgtactcagagatggcggagcataccaagcggggggatttatggaatttcatctggcagaacgtgacgttaggacaaaaggctagtttgctctgggctgttggtgccggccggtatgtacagacctgcgggttatttatgctgggaatgttgatcgggcgcaagaagttatttatcccctcggaggagaattcccgtttttggatgaagaccttgatcattactgcgatcgctttcggtcctttataccaactgaaagtattgttgatggatacggcggacagcgctatcgtgcgccagacggcaggtgttgtgtttgatatgtggcagaaattcgcttttacgttcgtattggtggcttcctttgtgttactgtatcagcgcgaggcctttaagcgttttacctctatcttacgctcttatggaaagatgagcttgacgaattatgtgacacaatcttttgctggtgcgctggtctatttcccgatcggcttgaatctggctccttactgcggttatacggtcagcatgttcatcggtatcgcctttttcttcttgcaagtacgcttctgtaagtggtgggctgaaagacataaacacggaccgttggaaggtctttggcataagtggacgtgggtaggttctaaataaggatctgattatctggtgaaatgagatggggtatgtcccgtctcatttcattacaaacagtactcactccataaaaggtttggcatatttaatcattccatgcacgttcttgagtccttccggtgccaactcgacaaccatgcaatattcgctggggacatcgaatggaaactcaatgccgaaatcaatcgcccttttatatccgaatctcggataataatccttatgtcctaataagacggccgatttatagcctagctctccagctcgcttatgcgcttcacggatcaaagcgctaccaacgccaatcctttggtacttcggtaccaccgaaaccggtgctagcccaagagagatcacgctttggtcttctgatacgatttccaccttactcatcatgagatgccctatgatttcgccgtttaattcagcgactaaggagagctccggaatataagcgtccgtttttcgtaaacgttctacaaggtacggttcgctttgatcactgtcctccacgtcacggaaagcaagttccacgacttcccttactgcttggaagtcgttctcttgctcttgtctaatcttgatttctttattcatatgttgtgtatcaccggttatcgctcagacccgtatcgtgagtccgtttttatcttctgcgtcgaacactgcgtaccggagcggatttttctgctttcggagccttgacagtgggagctttcttttcggaggcaggctctttggttgtagtaccttttcctcttgcggcgctctttctggctttcttcgcggctttgctgtctaccgctacttgagtcgtatccggttgataccagagtgatttctcaaagctggttaattgaccttcgatacgagcttgctcgttctttaaggaatccggtgtcgggcaatacgcctgcaatggcagattcatcaagttttgggtcttgatgatatccccctcgaacatccggcgacggaaatagtcatccatcgtaaaagtcatggcgttattcatattagacgtcatgatgtatgaattgctgatatacggacgtatattctcgtaaggaagccagaacataggcatggttgtctctcccatatcacctgtagaggtaaggatcgggcaaatcgccaatatcttgacatcaaaagcggaattattctggtcgaaataccatgcttcttttacatagtaagaccgtacgtcggctgcaggtatatcgctttcattgattacgaaagtcggttcctcacccgctctccccggtatctcctcataaaggatgtagaagcgatccagcaaatccttgaagttgatcaaatgggcttcgtcaaactcctcgtatccgtccagatactcataggccttgatcttgttctcacctaaaagctggaagattacggagaaaagattcatctgtccgttcatcgggcgggtcgggtaataaagcggagcgttctgctctttcatcaagtccacctgccggtagataatacgcatccagcgagcgttcccgatctcttgcgtcaaacgctcgttcatatcttgggcccgtacggtcagttcgggtaaaccggtatctttcttatcgtttctttccccacggctggcttgaggcgaacggcgacgcgtttgttgttgctgcgtagcttcgttctcaacttcttcttgcgcatgaagaggcatcgctgttaaaaaagtggcggccaaagcggctatgtaatacagatgtttcatactgcgaatcttaatttacgattacttcgatagtcggtatggtacgttcgataccgtccggacctttcgcgactacacgggtgatataaaaacgtttacccttacttaaattgcggatatagtttttctgacgttgcgagaagttggttccttcggccacttctgggatagcgttacccatggagtcgaagaaagtcagctcaaaacgtaataccgtatattttacatttagcaaatcatcgtcgatagcggccagaataccgtcagcctctaccaagctacgtttggcgatcatacctcccttgaacttacggacgttaccgttttgatccttatactcgatataaggtaggggatcggggagggcacgcacgcggaaggtagtctttgccatctctatgttccggccatccgccatgcgagcgtttaccgtgatcacggcttccgttcctactttagacgggcgggcttcccaaccatccttgctgcgggttaatgtgccgttcgtcatggtagctgtcacattaccgctcggtacacccgggacggcgatacgcatcgggttggcgataccggcatataatacgttcatcaatgtcggggccacggtagctgtcggctcggtcacgaaatactcgctctcgaaatcccggcgcatgatgctgccgtcgctattcggcatctcgatataacctttgatcgggaatgtcccggcagctccggtattcaccgtgaagactcctttattctcgtaaggtaattcttttccgtttacatagatcgtaggacgtttcgtagagtctaccgccgataatacgatattcgccttgtactggcttcctcgcattacgatctggctttccgggattacctgcgccgtgatctggttcacacggtaatcgccaacgtctacgctattcaataagttcgataggacctcaccttcggcgtagcgaacgtcactttgcatttttgttaacagggtaacagccgccgctaccggcatattctcgaacaaggcctcttcccaagtacgggtattgatccccgctttatgagggggagtcgtgcttaggttcgcctccaatacggcagtcttcgccgaatcttcgataaagccgcccatccagatacgatacttatcaatttccgctctcagctttttaccttctccgcttacaggagagagcattacacgggaggcggcttccaaatcatccttatgctcgatgctgtttacgttggcgttctcgccatcagctaccttagcgatacggatctttaaatcttgtatatacgcataaaggctatcagaggctcttttcacctcacgggctttcaaagcccattcgcctaccttctggggattctcttggtaataagcttccatctcgtccgctacgatcttgtttcggcgggaggagttatcgatagaggttcgcaagctaccttccaccaactcaaaaccatccagcacctccgacgacacattcagtgccatcatggcgatgaacaccagatacatcaggttgatcatccgctgacggggagaattgggattatttgatattcctgccatatttctttacttcattgggttgtttgtatacggagcctgttgtggctgttggtaaccatagggttgctgatattgctgttggtaaccgggctgttgtggctgctgatacatcggttgttgaggttgttgttgcggctgcgccggttgttggtagcccatattcacggtcatcgcttgcaataaacgactgtatacttggttcaattcggccagttgacgagtcatcttttccgtctcgttacggaatacggaactatctaccaccgatccgtcatacatctcacggatacgattcaatccactattgatgtgttcgatagattcgatctgcgaactgatactcttcaactggatctcatagatggtattcaatccggatacgttacggttcaattgttccatctggtgtacgtaaccacgggagttttggttgatgccatcggaattatccgtgatactcttataagagttcaacagtgtatcggatacgttcgtaagcgaattagtcacttggctgaaacgctccatgttctcagacatgccagataattgctccagatatttttgggtagcttccgtcaattccgccatcttggaaatttgctcggccgctccgcttaatttcttgatgctctcggataagttcttggtatcttcttccgtcacgtccagattacctgcgatattcaaggaaccacctctttgcgcgttcgccttagacgctgccgaaccgatatttattcccccggctatctcatcgtcttctacattatccgtagaattgatcatggttgagatcggcgtaccggtgaaatccggacgatccatcgggttctttgatttcaatacggggaaaacatcttcccaatgatactccttgttcggatgctcgaacgccgagataaagaatacgatagactcggtgatcatcgccacgaacaggatttggttagcgtatggtatatgtaataacttaaataacgcaccgaggattacgatggacgcaccccaactatacaggaagttcaatactcgttttcctctttcgctggagaggaacatctccagtctgtttttatatcttctatattttcccatcgtcgtattattgtcttaaatgattcaaaactttaaatttataattcccgcttatttctttcccttggagcgagagaatcctatttgggtacgtgcgcaacggaaaccgatgtaagaacggctctcgttctggaactcgaaagtacgcatgtccgaacggataaattgtgagacatctttccaagaacctcctcgcactactttctttttcatggcgtagggatcgttcttggcggcgttgtaacgcagatccgggttcatgtcgctcatttggctcgggccagactcggagtaagacgttgaggtccattccgccacgtttcctgccatatcgtataacccgaactcattcggggcgaaagagcctacacgagacgtaatcaaatggccatcctccgtataattacctttacccggtttgaagttacccaagaaacaacctttgctgtcttgaagctcgtcggtagaccaagggaacttattctcgttcttacctgtacgggcggcatattcccattctccttcggacggaagacggaatggctctaccaattgtcccggtggcaagctcaaggattctttgtataaattcgtacgccatacgcagaaggcagtcgcttgttcccaagaaacaccgactacgggataatcatcgtaacccggatgagagaaatacatacgggtatatggctcgttgtacgcattcttgaaatcgttcacccagcaattctcgtccgggtagatattgacgatacgggtattcaagaaatcccattcgctgcttaacgggcgggtgatcgtctcgttgattacacgtccttcatcatcgatgtaagcggtgtccttggagatcatgactacctcgttcggatctacctgaatatccgtattacgaacccggtccgccgggttcaactgattcttgcggagagcggcggcggtatagtcgtaccactcgtatttatagatcatttgtttagggtccaaacctttctctccggtaacgggattcgtgtaatagacactttctatcgcacgttgctcatcctcgttcgcccgtctccaaggaatcggacggttccagtccaaatgcggagtgacaggctccccgtaacggtcttccgtgatcttgaacagatcgttgcctccataagccgggtccgccaagcgttcacggataatagagtccctcacccaataaacgaactggcgatatttggcgttcgttacctctgtctgatccatccagaacgcgtcgaaagagacccctttcgtctccggcatgattccccacaaggaatccttgtcggcgggacccatctcgaacgaacctcttttaaccaagaccattccatacggcgctggttcattgaacgctaccgatctgacacctgtcacctcaccgccggcactccggagagatttaccgcaggaggtaagcaaggctaccgttacaagtactaataatacttttttcatatactataatatacgtacacttttatgtctatttttccctgtcttcgtcttgttcagctttaaggcatacttgacacatagctcgtggctaccgctacttgcccggcctagggccgtggtcgggaaatcaaaggcgtaacccgcatggaaacgacctagctttacgccgaacatgatgcccaccgattcattcacccgataggaaaaaccaccattaaacatcttattatattccagcctagcggtaatatccgcatgaaaactttgcatgtcagtcagcaagaacaccgagggctgtaattctatcaacggattctttaattgaatattgtatccacccattaaattaagtgaacgacctatataggtataggcgttctcgtccagttgaagctccggttgggtgatatgcgtcatgccaaacccggcgtaaaaccgtttatgggtatagtaaataccgaagttcatatccaaccccatgccgctgacctgctctacaggaatggcggcatcggtctcttgatggtattcggactcaacctttatcaccttggttccgtcgaacgattggttgactaagccgatttgtaatcctccgctcaagactcccccgaataatttatacttataggcgtattgcgcccctacatgcgtattctggaaaagcccgatcgcctcggtaaatacaaccaatccgacaccatgattcgtcttgcctaaagcgagtggcatatccgcagtaatgaagaacgacttgggtgccccatgtacgccgatcatttccaagcgggcgagagccaatatattcaagtcctccgtagctccggccacggccgggttataatacggtttcgccatgaagtattgacttaagcgtgcgtcatattgcgcccgtacgattcccgcacaagtacacaaaaggatcaagatcgaaagaagacgtcttctcatttaaacattcacttcacgttgtaactacaaacgcagcaaatccggataaattgtattttcacaaaaaaacaacgaggcaggggagctcaatcgtccgccacctcgttcttctatttcttaattttcaatttccaattctcaattgaactagtattcttcctcgttgaagaagaagtcttctttacttggataatccggccagatgtcttccatgcattcgtaaatctcgccttcatcttccatttcctgcaaattctcaatcacttctaatggcgcaccagaacgttgtgcatagtcaataagttcatccttagtcgcaggccagggtgcgtcttccaattttgaagctaactctaatgtccaatacatagctgtcaagtattaataaccgccgaagcgatttggttctctatttttccgcgaaaatatgactttatttattatacgcaagtataatcccaaataatttctttaccgttattatttatgcattcttttcgtgccagaacgaagaaataatccgataaacggttcataaatatcaatacaggctcctcaacggggcaattctcggccaagcgatagatttgtcgctcagcacgacggcaaacggtgcggcaaacgtgtgcgagggcggccgagcggcatcctcccggtaggatgaacgcgtgcattttcggcagctcattatccagacggtctatctcccgctcgatacgctcgatgctctcgggcgttaccttgctctcgattttcaattccgtggtcgcttgatccgtggctaggtaagaaccgatcgtgaatagcttatgctggatgaatgataagaaatcagtatctttctcatcattcaaggccgtgattaataatccgataaaggagttcagctcatctacggtgccatagctctcgatccgatcgtgcgctttcgacacgcgttgtccacctaccagtgaagtggttcctttatcgcctgttctggtatagataatactcttcttcatatctgacttgttttgaatcctaaaaataaacaatataatctcgtttgtgcaatttcttgttgaataagacaatccctagcgagtaaagatctaaggtgaccgtcacttccggacatgcgcagatctcttcccaaagttcacgcatcttacggctcgccttgattccctcaaaaacgaataccgtatcgttgtgcgcgtatttcatacattcattaaacagccagaggttgttatgttgttcatataaagtgttgaaaaaaacaaaatctaagctatttatgtcatttaaggcttggggaagcaagtccttataattaccgatacgcaaatcgacgggattacgtccctctttagcgaatgcttgacgggcaatcgtggcgaattccggtacattttccaaggcgatacatttcaatcccgtggcataggaggttagatataaggtagacaaccccatcgtggttcctatctggaggatattcttggacttgaaatagtttgtcaaacggaataataaggcgccatgcttgggccggatggattcccgttttacgatctcgctgatggaacgggtctttcgtttccctttgttctgccggtctggataggtgatctctccttccctgaataataactgcttacgtaaaagctctatatcatagaaactataataggagcatttttcctcgatgaccttcgtgatgaggttaaaaacgaaaggcgaatgtactccgaatcctttacggtaacggatgctgcggtacaagagcgatccttttcgtaatgtattaacctttggtagtatttgcatttctttttgtcattgggcaatgagaccttgccatttaccgcgaacttacataaaaaaacgcaattagcataagcctctagtcattaaacggggttataatgacttgtgccatgcggatggcacagccgtgccataacggtggcaccagcgtgccatcgcagtggcacagtcatgccatcagcatggcactggctttatcttagaaactggctttctccggttctgggcggatataggttaatatctgcccgcttaattgaagcagcgagatctcacagatcttggtggagtattccgccacggaaagacgctcctccgcttccagcagactgttttgtgcctcacgcaattcgataccagacaactcgccgagtttatagcggtcgatggcgatccggtagttctcttgggcggctacgaggttctctttctctaggctccataggtcgaggttgtttttataggccatccagaagttgctcatgtccgcacgcagggcaagttccagttcttggatgcgcaattgctggttctcgatttggatgcgggcgttgcgttgctcacgtttccggttgaaaccgtcgaagaggctcataccgatggtcacgccgtaattaagccccagccgttgttggaggtcgtaattgcccacttccgtccagttcgccgtgtagccgtagcctgcgtttagcttgacatagggataatagcggctttttacctttttataatcaagctcggacaatgtctggttcttttgggcgatcaggagcgaggcgttggcttcgagggtattcttccatagatctacctcgtcgaggaacgggttcgggtagatcaaggagtccttgatctggatttcctcctccacattatttaatgccatcaactcgttcaggcggatacgggaggtatgcacgacctccaattggtttaataccttggagctatccgagttgaagtccacttgagcctgttgcaagtccagacgggacatggagccgatataataccgttcttccacgatccgtaaacgctccttggaaagatccaaggtggaacggaggttacgcaaacggattttctgccggattaggttgtagtactcgctggaaaggttggctacgaaatcctcgatggtcatgcgggtgttcaattcccccattcgctgtaattctttcaagcgagagtattcggcttggataccgaaaccgtcgaaaaccgtccagttaacgtttagtccgacgttgcccgtctcgctgtttataccattcgccttttcgatcgatccgtcttgcaggctgttacggttgttattgatatttccgctgaatccgccgctcatatctacggtaggcagataaccggcgtttcccggggtggcgttattgtcgctgatctgttgctcgttacgaatgatacggatggagtagttctgctctaatccggtttcgatacaccgtttcagatcgaatagttgctgcgcttccgctataaagagggaagagaaagcaaataataaggtatatacatatttcttcataaatctacaactaggtgttttgtttttttcggttggtggatataaatgaatacatggccggtacgataaacagggtcaagaaggtggataccaacattccgcctactaccgctacacccatggcgatacgcccttgggcaccctcgcccgtagcgtataccaatggcaccaaaccgaggatggtggatacgctagtcatcaagatcgggcgcagacgctgggtcgcggacgagcggatcgcttccggcaaactaagtcccgactcttgccgctgattggcgaactctacgatcaagataccgttcttcgccaccaaaccaatcaacataatgataccgatctggctgaatatattcatcgtgatacccgaataactcatgaacatcagcgcaccggcgatagccaaaggcacggtgaacatcactaccaacgggtccttgaaactctcgaactgggcggccaacaccaaataaatcatcagcaaggccaagatcatggcgaacatcaaactggaagaactctcacggaactctttcgactcgccggaaagagcggtgcggaagctaccatccagcacctccgaggcgatacgatccatctcgtccagaccatcgccgatcgtgtatcctttattcaatccactggaaaccgtcgctgatacaaaacggttatagcgatacaattggggcggcgccacattttccgtaaccttaaccaagttatccagctggatcatttccccattgttactacgtacatagatcgattttaaatcgacaggggtatttcgttgctggcggttgatctcgcccaatatctggtattgcttaccattcatatagaagtagcccatacgctgtccgctcaacgcatattgcaaggtctgggcgatattccgagtgctgacacccaataaggaagccttatcccggtcgatctcgatacgtgcctccggcttggtgaagcgcaagttcacgtccgccatctggaagaccgggctctcgttcaccttttgcataaacgtgggcaggaactcttgcagtttatccaaggtcggggcctgcagtacgtattggataggcataccgcctcggcgtccgccgaaggtggattgctgttgtacgaaggcgcgggccaaggtctctttgcggacttctttcgacaaggtctcggcgatctccatctgcgagcgttcccgttccttgatatcgcttaatatgaggtttagcgaacctcctccttcccacgagcgggtcatgatggattgcttctcgggagcgatggagtcggctatttgctcgatacggtccgcgtagtcgcggataaactcgaaggtagccccttccggcccgcgcatattcacggagatcatggaacggtcctccaaaggcgataactcggaacgaatgttcttccagaagtacccgatcgatccgaaaagaaggataacgatagggatcgaccatatcttatggttcaagaacgcgttcaacgacttggcgtagatcgtgttcaatccctcgaagaacggctcggtcttccgatagaaccagtttttcttctctctcctcttcaatagcttggtagccaacatcggtgtaaacgtaagggccacgaatgaggagatagcgaccgaaccggcgatcacgatactgaactccttgaacaaacgccccgtcataccttccataaacacgatcggcaagaatacggagatcagggtgatcgtggtagataccacggcgaagaagatctctttcgatccttcgatacccgcctctttcggcgacatgccttgctcgatacgtacatatatattctccgccaccacgatcgcgtcgtctaccaccagaccgaccgagagcacgaccgccaacatcgtcaatacgttgacggagaatccggagatatacatcacgaagaaagctcctaccaacgatacggggataacgacgacaggaaccagcgtgacccgccagtcgcggaggaacaagaagataatcaatacgaccaagaggaaagcctcgtaaatcgtctgttgtacttcactgatagaggcccggataaagcgagtgttgtcatacatcatctcgatcgtgacatcttccggcaggtctttttgtaattgctcgatacgcttgtaggcttcgtcggcgatctcgatatggttggctcccggttgggggatgataacggtcataaccattggctcgccgttcttcttcagtaagctccgcaagtcctcgggagctacctccgcacgtccgatatcgctgaagcgcacgatgttgttgttgtcttccttgataattaaatcgttgaattccttggcggtatgcatcaatcctaaggtacgtatggataaggagatcgtatttccctcgatactaccggaaggaagctccacgttctcgttatcgacggcgtttttcacgtccatcggggtcactccgtaacccgccatcttgattgggtccagccatagacgcatggaataccgtttttgtccccagatatccacgccactcacgttctcgatggtctgcaagcgctctttcaccgtcagctcggcgatctcgctcaactccatcaacgagcgtttgttgcttcggatggcgatctgcatgatcggggaggcatcggcatccgctttcgataccgtaggtgggtcgcagtcacggggaaggtagcgttgggcacgagataccttatcacgtacatcgttcgccgccgtttccatatccacggacaactcaaactctaccgtgatgcggctgctgccttggctactcacgctactcaatgaacggatacccgggataccgttgatattctgctccaacggctcggtgatctgattcatgatcacgtcggcgttcgctccgggataagatacgttgaccgagataatcggctggtctacgctcgggaactcccggacgccaaggaaccggtaaccgataaagccgaacaggaggatgaccagcatcatcactgtcgagagtacgggccggtttatactggtttctgaaatatttgccatcgttcttctccttattcagtcaagttatcaatagaaactttcatgccggtacgtaactgcatcactccggacgtgatcagcgtatcgcccacattcaacccttgcaatacctgtacacggctctcggttcgaataccgatcgtgatctcttgaggctcggccacgccgttcttatataagtaaacgatgtcttttcccatctcggggataacggcctcgctggggatggctaaagcgtccttgatctcccgcttgctgatctcgacggaggtataacggccgggtaagatattctcgcccggattcgggtaagtggcacgtactttcaaggtacgggttgccatatctaccttgctttccacggcgtaaacggtcgccttatagttctgcatcataccgtctttctccatgcggaacaggatcggggttccgtcttgtacctcggccgcgtagctctcggggatggagaactcgattttcaaaggggatatcttggtcaacttggcgattacggaagaggaggaggtaacgtatgcgccctcactcacggagcgaagtccgatgatcccgtcgaaaggagcccgaagctctgtctgggcgatattcgctttgaccagctcgatatccgccattagcttctcgtattcggtggctacttgctcgtaggcttcttggctgacggcgtctttctccaacaaggtacgttggcgatagacacgatccttggctaaagggacttgggcttccagcttctttagctgggcttgcagcggcttgtcattgattttggccaacagatcgcccgcctttacgtgggtaccttccgtgaaatagattgctaccaccttaccggaggactcgaaagccaaatccacctcttcgtccggaagggtactcccggtactcatgatcttatcggttaatgattggtattttaatacctcggcgttgatgttaagtgtctggtttcgcaggctcgtgcccgatgtgggtacgacggaagcggcatcttgggatgccttgaacttgtttttcaattgagggtaagcgatcattcccgctatcattaataagatagccgccgtaactccccatttcgctctctttgtcatcatgttctcgtatggtatttactgataatttacactcgttactccaaaatatataactaaacgcaagtttagactcccctttcgtaaaaaggtttaatcaaagatattatttttttgagagatgaatccctgattgggaagaacgggaaaaataagggaattaaaacgaatctagggaggaagtctgatctgtgatagaaagggtgtcaataccacatattgatatctacctgatatagacgatacaatccggttcaagtagatatcaatcgtgcagctctcttatttcagagcttcaatttcttcaagggaaaggccggtggccgaggaaatttgttctataccgagtcccatcctctttaggttgagggcaatggatcgtttaccttccttcaagccttccgcccggccttcctccatcgctttctttcggcctttctctacggcgaagtccaaggtgttgtaataatcgttatagatcttccactcctcctcgtactgcgcccgttgcttgggagtgaggtttgccatcgagccgatccgttccagtcgctcgaagatggccttgcgtgccttgaaaggcattctgtctaaagtatccatatgtttcaatacataaatccaacgttcaaaatctgtctcacattcttcctcctctttcttgaatcggggaagctcgatatagatctggcggaacttggggttgaatacctccctggtctcccggtccgccaagacgatgtctcttcggaatttccccttgtttccggttccttttccctcctccaatgtgaagtttaagaaaaagaccccgtatacggccgccaatttatagtcccatacccctttgatcccttggtctaccaccgatcgtgcgagataatacaaggtacgatccttgaaatagggctgttcccggttctgcatctcgatgataatccgctccccgttgcttgtctcgcagtgaatgtcaaatatcacttttcgctccaaagccgtctccggcatttgctcgttattcatgattcgcagatccgtgatgacatgctcaccggctaacaggtcgttcaagaactcgattaatatgtccttgtctacttccctcccgaagatgtgcttaaatccccaatcggtaaaggggttgataaattttcccatagtgtttataggttttagtgattaataatgaatgattatatataatgagacaggctatcctgtcttccggttgtaaagatacaatctttttaatacgaaaggcttagttttggcttttaaaaaaacacgtacgtgtttttgggggatataatggtgataggtggtgtaaggcaacgccagtagtgccgttaggtatcgtgaataatatggcgacactgatactcacacaaggtgcgcatgaagaaagtatcttagtttcatcgccccatgcacctaagatacttcgccaatgaacttaggatactttctcaatgaaacaaagataccttgtttttgtattaaaaaataagattggctactgcccgaagttcttcctaattttgcgtggctaacagatacgcctatcccgactgagtttctactgccccgttattcactagacaagcattgaattatatgtttgtggtattcgctatgattaccatgtgaatgtttgtattttatatttattatgcggtatggatggataccatatataatgtacatgcgtacattatataaaaggtataaatgactagtttaaacgatcgattcttttagtcatttgcaaaggtacgcgtttcttcgttacattgtctatgtaatttttatcgttatagatggacatagttcgtacggaactagtgcgccattcatggtctatatcattaaaaactgggcaaatgtataactttttttgtaaactagacttaaatctatagtatttttttaataaaaatgacacatttatcacaaatcaccccttgaaaccaagaatatcagcccttaaatgtactaaaaatatattgttccgtacggacttacaatagtatcatcgtctttctatcacataaataattaactatcaaatattaacagtaaaaacactttaaattggttacaataaacaaatgttaaatttattgagattcaaggctaggcgaaaatggcactagtatggcttctatgaaaaaaacagataatatattcagagactggataatataaaaaaatttagccttcctttataaataaaagaagaaccacattatctacaatctttctaccaagaaagcgccatagacttattcccacaaggcttgaaatccaataaggcattacccgaaacagagtctctcatgacactcttcacccatcactctaacacaagcaagtcttctgcttagaataataccgatttatttgggattaaatcctatcaaaacattcaatatacaaacataagacaaactggataagggcgggcaaaccccgcccctaccatgctaccaagataattttataaacttattctcccacggagcgaaactcaacggattccccgaaactgggtctccaacgacatcacaaaccgtagtttttacaaaattaattttatctgaagttacggagaaagtagctggcttcccgcctatctcacgcaattgaagcataacagcattctcgccttccacaggcctcatgtttaccaacaacaaattctccggtacgatcttgaaaatggaagccgattgaagaggctccacctttttatctccggcaggcaaaacacgggtcaagaacggaatccggttttcccaagcgaacttagtcgcatactcaatagtgttgtctttcgaagagttgatgaagtaactccattgcatctctcccatttggtccgcattgaaattggttacccaatagttgttcatcggccatgaatacatattcgtggactgaggtacggctccggccttataccgccccgtattgatcgccccaaattgcattaatggtatttcttggctacccatcacgacctgtgactctccattacgagccgtagcgaagttttgcaccgtgtaccaatcgttagaggagcccgggatttggtctacacccgcctcaatcgatccgccgggtacatctaaatggatctttcctccttcaacctcaaacgggaaagcgatataaaccgcttccggatctgttaccgcttttttacgcaagcgataaactacctcgattttctttgttacgttaaatacacggaattccaccatcaaattattcggctcacgtcccgctactgtctctccccggaaacgatatgtatcccagacatcgcctttctcatatttctcgaaacgcatcttctctgggcgacggcggaggaattgaggagcacgatattgttccatcggatgacggctatcgataatctcataaataaactctcccatctcccattccgcatccggcgtaaccaattgtttgttcaaatccttatcatataatttacgaatcgtacctttacgggtattgaagtcgatggcataccaaggattctccacatgtgtctcttttaattccgtagcgccctgtatttccggacgtggcgcatcctttacctttatataatactgcgcatatcccaaagccgggacatctttcacgtaaaagttccaataagtaccatcggaacggctttcgccagcttgtgcgggaattacgttgccagccgcatccacgatctcgaaagccttgtctttcggaagaatctgatgatcgacataagctttagcgataccgctataactccagttgagcgtattgaatacagcgatagacggaacgtcgcttttgggcacgaacgattgtaatatacccatagtggcctctcccagcaaaccggaatggcgataggcttcccacgcatacgattgtttcaaggagcgttgttcccaagtttccagtccataagcgttacgcacgctctcactatgcccgaaagtatgctcatcatagaacaaaagagctttgttgatatcataaatccgatcattgatgtctgtcggcaattgagcgcctagcattttggcgaatgacaatccggcttggttcgcgataatatccgagtgagtcacacgagatatggcagcttcgcgagcaccggaagcgaaaccatccgtccaccaatccggccaagctccacgaacggtctcaatacgatccgcgtattggctctctaccgtcttaaagaattcgctggctaccgccgtgcgtaatttcggccattcatatttctcattccatttttgtagcatctcacaacttttcgtggatggaggcgcattatccgtaaaataacccgaatgctgggcggccaatatatcatacggatagtttttcgcttccatttgatccagatacgctaagacccgttcctcgaactgctcaaaatcatcggtatggataccaaagaaatttccttggttataatgctcggcacgataggtcaagaccttcttcccggatggagattcccaccagaatacggtaggtttatcaaaacagatcaacgcacggtggccatgggttcccatattcacatatttcacgccggcatccgcgaaatactcgctgaagcaccaaccgattccattcacgtcgtcttgcatagctacctcggcacgcatcccgttctcacggaattgcttgatcggataaagggaggcggcgagcgtttgctcatcgggtaattcgtcaaagttcaagtacatcgtagctaattcgatacgaccctcttttacccgctgcttcaggcgagcgatctgttccgccggacggcatttcaaatattcgctaaccgcccaagcgatctcgcaagtccaacggaatttagcgaaatccggataattatccgtagcatcacaataatccaacgcataatcaatatatcgtagatgttccgctaagatttccatttgggaacgagtataaccgatatccgtatgcgtgtgctgcaccatattcatctgccaatggcgaaccggttttacggtaaccgtactttcctctttctctttcccacttgtcagcgtcaacggtaattggcgagtcgtgctaacctcgggtatctcgattcggaatacattatccccggataccagtttctctttatggctttgctcgcctaaacggatcgtcactgtagaaggttctccttcatgttttacggagatctcgaccttttgggtcagtccgtttttcgatttataaaccgccggtaatacacggctcttgatatccgataatcccggagacgcatgaaccgacaatgtcccgatcaacaaagccaatcctgctgataaataagttctttttttcatcttatcgtgtttttattgatataagtcctatatacaacatacatattaataatagcatcaagccggctacctgtccgaacatatcggctatgcctcccatacaaggcgtaatcaaagcgcctcctgatacacccataatcatcaaggccgagacctcgttcgattgctccggccgatgttccaacgcaaaagagaacaggatcgaaaacacattcgagcaagccaagccaaccagtacgatcataacgcccatgccccacaagctatccgagataagcaatcctacgaaagcaaggatagcgataagcatgcttccccttaagaagggtcgtgacgagatcctcgccagcaatatagcccccaggaaagaacctccggtacgagcggcgaaataaaggctactccctaatccagcctcttgcaacggcatggataacttttccatcaatagcttagggatcgtcgtattcagaccgacatcgatcccgacaatacacagaatccccaagaaaagcatccgtatcctagcatctttacataaagctaacgtagaggcgaacgaggcttcttgcccctctccttcctctttacccggaatagtcgttatcaaccagatgatagataacaaggtagtcaccgaatagacaatgaatatcaacttccaatctccccagaaagaagaagctacacctgcgataatcggccctaagaaggaagataccgccttaataaactgccctaacgtaagcacgctcgttactttatccggatttaccacccgggctaccatcgggttcaaagatacttgcaagatcgtatttccaattcccagcaaagcgaacgcaaacaagatacaagcaaagtcatagaagaatagaggtatcagcatcgccaaggttgtgatagccaaggctacgaccaccgtattcctacgcccgtgccgtcccatccagataccggtagggacagagaacagggcgaaccaaagaaagaccatcatgggcaataggttcgccaacgtatcggacaaaccaaagtccatcttcacataattcgtggcaattcccacgacatccacgaatcccatcacgaaaaagccgaaaaggatcgggaatatagcggagttcgtacttttagttctcatatcgatcttttggttggttacccatttctaaaaccaaatgtccaccttgaacaatctccgagaaaggaatacgagtatccgtcaatggtttcccgtttaagtccatggattgcacgtaatcattttgcttactattattacgagtctcgatcacgaattccttccctttataatagcggtcattcagccggatcgtaatcttatcgaacaaaggactacccaaagcgaaagaaggcgcttgatccgtcaagcctttcatatcgaataagcctaaggaagagatcacgtaccaagccccgagctggccttgatcctcatcttgtccgtagccataaccgtggatgccatccgtaccatagaactcattcaagatcgcccgcacccatttttgcgtaagcgagggacgaccggcctcgttgaacatccaagagatgtgcaaacaaggttgatttccttggttatacaaggtttgcaaaccggcgaaagcccctacttccgtgcctccgctaaagattaatttacgagacaccgtgaagatactatccaaccgatggttaaacacgtccgcacctacttttgcgaccaagcctttcgcgtcgtgcggtacatagaatgtatattgccaagcgttaccttcttggaatccgcgccatacttgcatcggattgaagtcctcgataaacgtaccatccttctttttaggacggacaaaattacaggaagggtcatagatacgctcccagcctttcgataagtccatcaaacggttataatcgtccgtcttacccagttgcttcgcccattgggccacggcccacgcactataagcatattccaaggtatgggaagcggaaaacatgaaagcctcgtccggcccgtcccctttatccaaatgaggtacataaccatattccacgaaataacgggtatcgatctttcccgcgcccaacggacgattctccccatccaactcattcttcaagcaagcctcataggccgtattcacatcgaaatcccggatgccacattgataagcgccagcgataatcgtacttaataaattcgtaccaaccccggagacataacggctattagcgattccatccgccagccagccggcgtccttgtacaccaacaaatggctacttatataatccgaataatattccggataggccaaagcccaaacctgtgtcagattccattgcgctccccaagcggcatcggtattgtataagttatgtaccggtttcccgtctttcaaagggatttgtcctaccgagccatcatttctcggataagcgccattcacatcgctagctaacccacgccccaataaagcgtgatacaaaccggtatagaatttcaccttatcctctcgcgctggagtctctacccggatacgtcccaaatattcttcccatgtttggcgagatatttcccttgcctcgtcaaacgtaagggtagcggcctcagtctccctatttaaccgggcattctccacggatgtataggaaagacctactttagcggttaccgactcttgatcttgggtacggaatgtcagataaagtccggcccccacgcccgtcgctttccgttcatccggacggatatccgctccgttgaaagcgccaaatccaacgggaaccttgtccagcaccgccgagaaatacaaaggaaccgatgccccgggttgatatttcctcacatattcaggctcggtaatcacccagccctcgatatgcccgtcttccgtaaaagtaatttcagcatcccgtacagctccgctctctccttgacggtttcctatatcgaacaagatatggctatcctccccggccggaaatgtataacgctgaatagcgacacgaggggtagcggtaagctccgcacaaatcgagtaatcttttaggagaacggaataataaccggcggtagcgatctcgtccgtacggtcaaaacgggaacggtatcctatacctgtcgagtcgtctaccgccccgggaattgttttcaatggacccgtcgtaggcatcagtacgattccaccgatctgaaactcatgcaagcaggggaaaccctcgatcgattgatcccgataatcgtaaccggtcgcctcccaaccggatttattcccgatatgcccgttcgtagaaggagccggcttggccataccgaaaggcatcgctcccggggtaaaatgaaaccaacggcaatgcgccgtaccgatccgaggttctacatattggctaagctcttcttgctgaactttcttgccttgtgtcacgcaggatgtgaagaaagcacacgcaaacatcaggaaccatacaggtcctatactatatttttgtctcatattcctttagatagatggtttaacgcaaaaacataagctcccatagcgatcgagcgattagcaccttgtttacttacggtcacccctatccgtttacaaggatcataccctaccttgcgattggtacccggaatgggtacctcgacagctcctcctttagcgaaatcagcgaaactctccgcatcctccaaaagataagctttcatttgcaatcggccgaaacgacttccatccatcataccggtagatgagttcaattctttcaacaaagcagggagaatatatttagaagcccccgatagtccaccaccgatcacgatgatgccatcgattaaagtaatggcagacgccaacgcatcccccgctagctcccctaattcggagaaagccgtaatagcagcctcccggttacccgggcaaataccctcggcgatctcaaagatctctttcggagtatgcactcccgtatcaccggatcgttccgcatatactcgcatgaccgcacgtatgctgacactctcctctacgatatactccggatatttcttattccgaaaacaccagatatctcctcctgccgcattatctcccaatagaagctcttgattaatgacaaccccggcaccaaaaccggtacccaaggtgactcccagcaggttcttatattgcttcatgcttcctgcctcccgcaaacggcggtttatatccggaagggctccggttaacgcttctccatatgcgaataaattcccatcgttattgataaataccggtatcccgaatatatcttccagaaacggtcctaacgctactccaccccggaaagaggggaagttgggtaaatcgcctatgataccggcttgatagtctgccggaccgggaaaagcgaaactgatagcgaccggagtttccggcaagcctgcctgaattgccttaaaaccctctaccaaattgcctaaacacttatctaaacaatccgcgcatgccggaagaactaccggatcggctatctcttttccaccttggatggcagagaagacaaaattcgttcctcccgcatccaatgtcattactattctattgtcatttgtatacatcatatattccttttctttatttacccatgttccgccagtgccaccgtggtggcacagccgtgccatagggttggcattggcgtgccatcgcagtggcactaccgtgccatcaagggtggcacagttgtgcgatgcctatggcacggtgattattgcctaaatcgtacgtaagcttttatagtaccacagtatttacctacggacgatccatacgggcggatcgtatattcacccacgcaagccggaatgataaaagtctccgcgtaatgaacgatgaatggttcaaaagcgtttgtcggactctccacgatcaactcatctcccttgattacattcagtacttgcacccctccattcgtattgtgaggcacgatatccgtgaaccaatgacggcgggtctcgatgaactcgttctcatgcaagccggtccgctcctcccgccaaccgtctccctcggcgatcatctccacttggttgatcaagttatgacggacaaactccgtttgccgctcccattggatcactttcgagccgtggccgatattaatcggtcgaggcagtccgtccaatcccaagcggccccagtcccaaagcttaaaggtaaagatacttggggtagcgctaatctccagcaccatggcaccggctcccgaacaatggaccgttccggcggggatcagataatgatcatggcgtttggcaggccatttgttgacatatttctccgtatcgaaaggctttccggtctgttgggactcgtttagggcagcgatcatctcgtccggatttacaccggttttcaatcccagataaacggtagcgtcctcctcggcatccagcaggtagtagctctcgtcctgcgtataataaatcccgaacgtatcccggatatattgggtgaccggatgcacttgcaaacttaggtttcctcctcccatcgtatccaagaagtcgaaacggatcgggaaatcttgtccgaaacgagcctcgaccggcccgcccagcaagtctctcgtcttatagaataccaagtcattggaagggatctcaaacagctctccggcaactttcaggtataaactattttcctcgggcacgcaatcaaaacaccagccgaagttatcttgctttttatccagatcacagacctctttcatccattggccaccccaaggagccggatcaaagaaaggtactacccggaacggggtatgagccgttttctccaacccttctttcaagatctccccggaaatcatcttaggtgttccgacgatatgggtatccaaccaataatcgaccttgggaaggactttcttcttcagattatcgcaaacaatccaatcaataaaatatcctcgcttataatggtacgacggggcttcctcccggttttccacacctagcccgttcacctcttttctacgggaacgcatctggatctcccaacgagccatatccgcatagatcaatttgtccggagcggaaacgatctcggcggcggcgtggccataaacgattgtccagccttttccatcacgcaaggactcccggcaggcgttcaccttctcctcatccaagaaatccgtataagagaaatgagcccggcggccaaacaaccgatcatccgtcagataaggataggtcatcgcctctatatcttctgccgatttaaataaatctcgcgtattgataaaacgatcgggcgcgagcgcttgcagttcacgcatcaactcctcgtgatgaaccccttggtagcattccaccacccaaacttgtgatccattcgtttccgcatggacctccgccaatcgcttccgtatcgattcccagcctttccacaaggtaccgtctacaacggtggccggcattttatcataattactttttctcatctcttttgatatttaatattgcacgcttgtatttaactcttatttttctctgcccaatcccttaataattcaatcgccttagatagcactccggccgatcccttgaaattaccagagccgctggggacaccgcctttgccataccattcgtagaatccgtcattttggatcacacgctcgatcatcggatgaatctccgcataagcctcctcaaccattccattaacgacaagctgctggatcatccgaccgccaaaccaagtccaatccccgccattctgatacagataagcctttgacattcctccatggaaaaaaccatccggatacacgggatataaggtaagaccaatactcggcatacccgacaggcgaacattctcaagcatctgggcatttacggtacgtatctcgtctttcgataataagccggcctctatagcgatagccgtcccaccatgataatgaatggcaagttcatcaaaaccttccggaatcggagatttctccggataaatatgaggaatgaacttctggcgcttctcgtcccataaatgagcccgcacatttctctcgattccctcacgcagacttttccaacgggaggcttgcggggaatcgggagccatctccaataaataatctaaagcgataagaaacatagcgttatcatatacgtcaatggccggatcggatagctcattcatgtcacatccgaaatcatcgttcggctgcacgtctccccagtccgccgtcatcgccccgtatagcaatccatattccttattatatcgttctcgcatcaagtaatctaccatcaagttcattcgctccaagacggtctttccggccaccacctcatccagaataccccgatcacccgtcttacgaatgtatttacctacgatctgaatcaaggaagattcttggtccgtctctaccgtattcttaaaagcgacatgtttcggagcggcattcgaataataaggcgtatcatcataccatgtaaaatcttctttcagcacataaccatcgatcatctcatcattcggctgttgaagagcgaaaaacaataagatagcttcccgcagttcatgtggatcactctcctcgcaagcgatctctataaacgtattcatatcacgagcccatatctgggaataaccgctgcccgcgttaaaaccattgcggatggtagcacgagccatactatcgaccttcaacaaattcgtatcagacaatatctgattggccaatcgctgtctatcggttaatcccgtacaagacaaaaaagatacaaatacaaaagaaactacaactagaattttattcatggcattatgttatgatttatgtcggcaaaattatttcaataatccagaaaggaatactacatttgttccgatttacttgtacaatcttatgatttatagatcatggtcaagataaaagaaggatttaagggagaacggctcgtttctttacccgaggaactattggcaagctaccggagggaaccgctcatcaataatttatatgtacgcaagatcggtttcttcccacgtgttaaatatcattttctccaaaaagaacatggctgtgactacgccatgcttatttattgtacggagggaaaaggatggtatcgtatcctcggtaaacaatataccgtggagaaataccaatatatcatcatccctcccggtatcccctactcattcggggcagacgagggagatccatggactatttactggttacacttccaagggaagcttcgcgatcaattcctgccgtcgcatccggttccggtcactatttcgccgaatgaatattcccgtttacaagatcggttacggctgtttgaggagatatatagcagtttctccatgggatatattaaagaatatatgatttattcctccatgtgcctttacaattttctggcctctttcatctatctggagcaattccgccatatcatgattccctcgcaaaaagaatatccgttcacggcacgggttattcattatatgcgtgagaacatccagcagaatcttaccttgaaggaattagcgtcttatttcaaatattccccttctcacttctcggctctcttctttggcgagaccggggtctcgcccatgaattacttcatacgcttgaaaatacagaaggcttgtgaatatatcgagctaacgaatatgaagttgaatgagatcgccacgcatctgggattcgaggatgccgcctacttctcgcgtacgtttacgaaagttatgggttgctctccttccgtttatcgtaaaaaggagatggagatatagaattcgtttggatttctagtatttctcataagaataaaatatatttgtacaatagatatttaaacgaacataaagtaagtagttactatgatagacctaacacagttcaccccttggactctctttacggatcttggattcatttcgatacttctattggttggcaaattcatacgagtcaaggtaaaactgatacaacaattattcatcccacccagcttgatcgcgggcttgctaggactggcgttcggacctaatggactggggtggattccgctttccaatgacttaggtacttatgcggctatccttatcgccttggtgttcggcgcgttgcctttatcttccccgaacgtctccatgaaagaagtagcgaaacgagtcgggccgatgtgggcatacgctcaggtgggtatgttattgcaatgggcattagtaggcttgttcggattgtacgtgattaagctgatctggccggacctgaatgacgctttcggcattatgctgccgacaggcttttatggcggacacggcacggccgccgctatcgggtctgcgttcgagggattgggctgggacgaggcacgcagtttaggcatgacaaccgctaccgtgggggttatttgctcgatcatcggaggtttactgatggtcaaatgggcggccaagcataaacaaaccgcttttatctcggatttcgacgatctcccggacgaactgagaagtgggttgctgccagaggataagcgggattccatcggagaggctacgacttcctccatatccatcgatacgctgactttccatgtggccttggtatttgtcgtggcttttttgggatatatggttagccaaaccgtaaaggtgtattatccggtattggagttacctgttttcagttgtgcctttatcattggattagtattaaagaaattcttcgacgcgacaaccatatccagatatatctgcccgcagacgacccagaggctgagcagttccttcacggatatgttggtagcttgcggtgtagcgtctatcaagctaggggtgatcgtaaaatatgccttgccgcttatcgtactcatcatagcgggcgtggcgatcgtctggtgcataacattcttcttaggaagaagattagccaagaccttttggttcgagcgcatgattttcgcttggggatggtggaccggcacgatggccatgggcatcgccttgctgcggatcgtcgatccgaaactttccagcaaagcgatggatgattacgcgatggcttacctgcctatcgctcccatagagatcttattgatcactttcgtccccatccttttcgtaaacggattgggagtttggttgctattagtctgcttggtcctttccctactgatcttgctactggcgtggaagatgggatggtggattactcgctcttgatactatttaccggattctcgttcgccgctttccagttctggaaactcacggtcaataacgtgattacggttacgatcaataaggcgattaagaatacccaccaatgaagcggagtcttataagcgaaaccctcgagccacatcttcacgccctgccaagcgaccggcgccgctatcacgaagcaaatacctacaatcctcagataggccttattaaacatcagcaggatctctcctaccgtagctccatgtaccttgcggatacctatttccttacggcggtattgagtctcgaacaccactaagccaaatactccgaccaaagagataataatcgccagtaaactaaaaaccgtaaccagatcgcgtagattctcctctttctggtaaagatgattaaagatctcatcatagaattcgatattaaacggataggaaggatctaattctttcatcgtctcctgaatgtgacctactacggcatgaatgtccaatccggctttcaagcggatataagagattggcaaagaataaccaaagtttccgaccaagaaagcgatattatcctccccaccacgaagcgaggtgaatttcacatcgtcggagaaaccgataagatgaccgggagaatagctatcgaacgcgtcacccacttgcatatccaacccctccatcgccgtacgattgaatatataagacgtatgatccgaaagttcgtccgcctttgagaaatctctcccttctataaccggaatccccatcacccgcaagaaattggaagatgctataattatgaaatactgaaagtccttacccttataactaccgccattcgtgttatacccgtccttagagcccactttctccatagcgaaagccacatcctcgatacccgggttctctttcaagcgattcacatatgtatcgtgatgcttatcgtacattgtctcattcagctccacgatagctacctggtccttatcgaatcctaaagagaaattccgcatataactattctggatttgcacaaagcaagccccgataatcaacacgatcgaaacaacgaactggacacaaatcaatgtcgtacgtaacttacgcccggaaggagataacccgaagctgcccttcagcaccaaggccggaggaaaagaagttatataataagcaggataaatacccgccagccaaccgataaccaacgctacgatgccacacaagaaaacgatcggaagatttgagaccaaactcaaatcggcctcgataaaaggtagcgcttccgcccaatccaatccccaaacgataacgagacttaccagccacgccataaaactaataagggctgcctctatcaataaagatctgcgcaacaaagtatccgagctacccaataccttctgcgtattgatgcttttgattcgcaacggagtcagagaagtgctaaagttcgtgaagttaatagccgcgacaatgacgatcagaagggctataccgaacaataaggccgtgacttccttgtttccactccggaatgtaccaccgtcttgcgtctcattcatataataaatatcagtcagcggaacgagccggatctgttctccttcatggtaaatcttcttgaaatcaaaatgacggttgaaattatcggcaacctcatctgccatggcaggattatcaagcaataaataacaaacccagttacttgagctaaaattattgatattataatccggatcgatcgccgtatagaccacgttccgaagctgcgtgttctccgggaaatccttataaaccgcaccaatcgtaaaaagcttagccgatttagtccagatattttcttccgctcgcaacgtcttaccaaccacagagatatcttccccaaacaacttgtcagccaagcttcggggtaccattactttctcgggatctttcaagcaatcgatatcgccttccacgatcgggaacgcaaatatcttcggtaaactagcgtggcaggttgtcacgatttccttaaacccaaacggttgcccgtttctatccaccgagagataaacaccattctggccaaaagaaggagtcaacaatgtacccgcctctatatgcggggaagattggatgacagcctccacaaaggcacggggtaatattgtcccgaaagtacccggaatggtcaagtccaccctaaaaatccgcccggacgtaggatggcaacggtcaaaagtccgctcaaaattaatctgtatcaaaatcacgataaaagcggcgaaagcaaccgcaagaccggctacgttcaatgcggtcgccattttaaaccgcctcaacacacttagaaagtttcgaataatcgttttcattttattatagtttcatttattattccgttttaatgctatccaccggattcgcgttcgccgcacgccagttttggaaagttaccgtaaacatcgttattaaggagacaattaatagagcgaacgcaaatatccaccaataaataggagttttataagcaaaaccctctaaccatttccgtacgccataataagccaaaggagccgctatgataaagcaaacgcagacaatacggaaataaatcttattgaacataatcaagatctcatgaaccgtggccccgaataccttacgaataccgatctctttccggcgatactgggtctcgaatataacgaggccgaatataccgacaatagagataatcacagccaacaggctaaacaataaaatcatcgtacttaaattccgttcttgatgatataaatgatcgaaaatctcatcataaaattccacctcacaaggatatgtgggatctaagtgggctactgtcttacggatatgatccaccacgcccatgatatcgcttcccgctttcacacgaataaaagaataaagcatcaaacgaggttcattaataacaaaacctaattcggagacgctttgtcgcaaggaagtaaatttaacatcatctacaaatccgatgacggaaccatcggccgattcctcctcaagccatggaatccgcatgatatcattcggttccatgttccatttatcccgcatttgtctattgaatacataactatagttgttacctctctcatcagactcggtaggcatccgccccccaatcaatggaatacccattactttgaagaaattccaagaaacagaaagagaagtgaaattaacactctgctctttatatacacctccccacgtacgatagctatcctccgatccaaacttctgggaacagaacgccacatcctctattcccggatattctttcaatccacccacgtagctatccttatggtcatgcataatattccggttcagctcgacaactactacctgatctttgtcgaaacccaaagaatatttttgcataaacctattttgttgacgaacgaacatggctgatataatcaatacgatagaaacgataaactgaaaaccgatcaatgccgtacgcaacttcttcccagaggaagaaagcccgaaagagcctttcaatactaatgccggagggaaagaagtcatatataaagatggatagatccccgcaataagacctattataacagataatacagctaagccacctactaaaccggggtaagcagtcaatgtcgtatccgcttgcacaaaatacagccatcccatatgtcctaatccccaaacgataaacaaagaacaaaggaaagcaagcaaactaatacccacggcttcaaataacagggaagcacgtaatatgccagcagaactccccagaactttttgcgtgttgatactcttgatgcgcaaaggcgccaaagaggtactaaaattcgtgaagttgatacccgccacaataatcaccagaaaagcgatcagcatcagtaaccgggctttctccgcgctaccgcttttcactaaacttccgctggaatcctcgttcatataataaatatcggttagggggaccagctcggcatgtatatctttcgccatatccccatattgcttcgaatagtcaaaatgggcatcaaaattctcagctacttctttcggggaggcagaaggatctagcatcacgtaacagaaatagttactacttatccaattcgtcagtgcgtaatccggagacatctctgtataaatcacgtttttcaactgtgtattttccgggaaatccttataaacacctcctacgaccaaatatttcacgcccggtttcgtccagatcccaccatcgggaacgatctgctttccaattgccgattcctttccaaataatcggtgagccatactttcgggcatcaaggctttttccggttccgacaagcaagaagattctccttcacacatcgtaaactgaaacatccgggtaatctccggatggcaagttatgatcgtctccttaaaaccttgctttccttcttttcttgtaacagtcacatacatctctcctatatacggattgatcaacgtaccagcctcaatatgcggggaagagtggataaacgcctctatcaacggtcggcaatggatcatgcttgctccatccgggaaagaaagtcccatccgataaatccgggtcgagttcggatgacaacgatcgaagttatgctcaaagcttacttgcaccatgataattaaaaacgcagcgaaagcgaccgctaatcccgctacattcaaaaaggtagctaccttgaaacgtattaatacattgatgaaattgcgtatgattgttttcataacttgctctattttattgatactaaaatcgacccaaaaagagtattccttaaataagatggctgatattcattcgtttcaagatattcaaagaaaccttgttcaacgcaattgtctcaacctcttccgtacggaaaaacttacttaaaccttcgattacattgtctatgtaatttttatcgttatagatggacatagttcgtacggaactcgcatgtgatatttaatctttttcgggaatgataaaagtgcgatgaatagggcatgatctagctcattggatttcttttttctaattctttttgttagatttgcacctagattcgtataatgccagaaattcataagaaagaaagggatatttctaaataaatgacacgagaatcactttctattcatgttaattaaatggatatttgtagtccaactatgaatataaaacacaaaaacggataaattatattattaattaaatagctatatcatgaagaaaaaaagcgtttgggctttagctttagcggcgatgttgatgtgggtgggaaaacctgcggtagcggctgtgaatgaggcttttgatccagtagagtatgtaaacccgctaatgggtacgcaatcttcttttgagttgtctacaggaaatacctatccggcgatcgctcgtccgtggggtatgaatttctggactcctcagacaggaaagatgggagatggatggcagtatgtatatacggctaacaagatccgtggctttaaacagacccatcagccaagcccgtggatcaatgattacggacaatttgcaatcatgccggtggttggtaaaccggaattcgaccaagataaacgtgcgagctggttctcgcataaaggagagatcgccaaggcttattactataaggtatatctagcggagcatgacgtggtaacggaattaacgccgacagatcgtgccgctatgttccgtttcactttcccggaaaacgagcattcttatatcgtggtggatgccttggataaggggtcttatatcaaggtgattccggaggagaataagatcatcggttattcaacgaagaatagcggtggggttcccgataatttcaagaattattttgtgatcgagtttgataagcctttcacatacgaggctacatttgccgacgcttctttgaaagagggtgcgaaggagcaaacgagtgaccatgtaggagccgtaatcggtttcaagacgaagaagggtgaaatcgttcatgcgaaggtggcttcctcttttattagcttcgatcaggccgctatcaacatgaaggaattaggtaacgataactttgataccttggttcagaaaggtaaggatgtttggaatgagcatttgagcaagatcgaggttgagggtggagatttggatcaatatcgtacgttctattcttgtttctatcgttcattgttgttccctcgtaagttctatgagatcaacgctcagggcgaggtggtacactacagtccgtataatggtgaggtattaccgggttatatgtttaccgataccggattctgggatacgttccgtagtttgttcccattcttgaacttgatgttcccgtcggtaaacaaggagatgcaagagggcttgatcaatacatataaggaaagcggcttcttcccggaatgggcaagtccgggtcaccgtggttgcatggtcggtaataactcggcgtctatcttggtagacgcttatatgaagggtgtgaaggttgacgatttggagactttatataaaggtttgattcatggtacggaaaacgttcacccgaaggtctcttctacaggacgtctgggtcatgaatattataataagttaggatatgttccttacgacgtgaagatcaacgagaacgccgcccgtacattggaatatgcttacaatgactggtgtatctggcagatcgctaaacaactaggccgtccgaaaaaggaattggatttatatgcccgtcgtgcgttgaactataagaacctgtacgacaaggaaaccaagttgatgcgtggcaagaatgagaatggcgagttcatggctccgttctctccgctgaaatggggtgacgctttcacggaaggtaatagctggcattattcatggtctgtattccacgatcctcagggattgatcgacttgatgggcggtaaggattcatttgtgatgatgcttgactccgtatttgctgtaccgcctttgttcgatgatagctactacggtggtgtgatccacgagatccgtgagatgaccgtgatgaatatgggtaactacgctcatggtaaccagccgatccagcatatgatttatttatacaactatgcgggtcaaccttggaaggctcaatattggttacgtcaagtaatgaataagatgtatactccgggtccggatggttattgcggtgatgaggataatggccagacttccgcttggtatgtattctcagcgttaggattctatccggtagctccgggtacgacccaatatgtgttgggcgctccgctgttcaagaaggctacgatccattttgagaatggaaacaacttggtgatcaatgccccgaacaacagcgataagaatatctatatcgaatccatgacgttcaacggcaagaactacactaagaattatctggatcataacgatttgtttaagggtggcgtgatcgacttcaagatgggtgacaagccgaatatgaatcgtggtattaatccggaggatatgccttactcattctccgtaaacgaggaagggatcaataaactttcccctatttctgtaaaacctagtaaaaagaagaaataagcaattaagatgaatttcattcataaaccattaatgtcaggcatagcgatatgcctgacatttttcgcatactcctgtgctacaccggagaagacggaaaacaagacagactttaccgcattcgtagatccttatatcggatcgggagaacacggacacgtatttgtcggggcaaacgttccatttggagcggttcaagtaggtcctcagaatatttttaagggatgggactggtgttccggttatcattactccgatagtatcattatcggatttagtcatacgcatttgagcggaaccggatgttctgatctgggggatatccttctgatgccttatacgggcgaggtacgtaccgcccgtggcgagcaagataatatagagggagccgcttcttcctattataaacatgccaacgaagccgtagctccgggatattactctttgctgatggataatggcgtaaaagcggagttgacggcgaccgagcgtgtagccttacatcgttatacgtatccgtcgggaagcgagcatcgcctcttgatcaacttgaaggaaggtatcggtgataaagcgtatgatacttatttgaagaagattgatgagtacacgattgaggggtaccgcttttccaaaggttggagcccacgtcacaaagtattctttacgttgaaatgtgatcagccgatcgagtctttggctgtattcaacgatgatgaggccgcgggtaatgatgagttgacgggcgagtccgttaagggagtgattacctttaagggagatgccccgaccgccttggtaaaggtcgctatctcttccgtaagttgcgagaatgccttggctaacttacgtgcggagctttctcattgggatttcgacgaggttcgtaacgaggctatcgataaatggaatgaccaattgtcttgtatctccatcgatacgaaagatgagcgtgccaagaagattttctataccgccatgtaccatgcgtttatcgctccgacgttgtattgcgacgcgaatggcgatttccgtggccatgatgataaggtgtatacgaacaatacttggaagaactattccactttctctctatgggatacgtatcgtaccttgcatccgttgttcacgattatcaagcctcaatatgtgtcggatttggtgaactcgatgttaagcatttacgaccagcaagagaaattaccgatctggccgttgattggtggtgagacggatcaaatgccgggatatagcgctgtgcctattatcgcggatgcctatctgaaaggttttaccggctttgacgctgaccgtgcgtatcgttatatggttgcttcctctgtctatgagaagcaaaacggggtgccgtacgtgttggaaaaaggctatatcccttgtgataaggtacgtgaggctacttctatcgcgatggaatacgcagccgatgattggggtatcgccttgatggcgaagaaaatgggcaagacggaggattaccagaattacttgaaacgtggtaaatattatacgcagtatttcgataaggatatcaactttatccgtccgaaaatgaatgatggcagctggcgtacgccgtacgatccgatccagtccatacatagcgtaggcgatttctgtgagggaaatggttggcattatacattcttcgtgccccagcatccggaaggcttgatcgagttgatgggtggcgacgctccgtttatctcgaaactggattctttgttcttggtggaaggtgagttaggagagaacgcctctccggatatcagtggcttgatcggcatgtacgcccatggaaatgagccgagccatcatgtcacttacctttatccatacgccggcgagcaatggaagacagccgagaaagttcgttacatccaagatgtgttctataccgaccagccggagggcatcatcggaaacgaggattgtggccagatgtccgcttggcatatcatgtctgccttgggattttaccaagtaaatccttccaatggcgtgttcgtgttcggtagcccgttatttgataaggcttccgttcatttgccggagggtaagactttcgaggtcgtagcccagaacaacagcaaggagaatgtatatatccaatccgtgttgctaaatggtaaaccttataacaattcttatattctgtatgatgatatcgtgaagggagggaatcttacctttgtgatgggcaacacgccgaataaggagttcggagctgccccggaaaatcgtccgaagacggctgagtaaatagctcccttaccagtgagcggtttgctctgttacccatgagacaacgtctcacggattgccgggaaagtacccggctgagaagcaaagaataattaacgaattaataatcgacaaaatgaagacaaagcttaaaacttcgatggcccttttggcttccgctttcctgtgggtgtcatgcgccggtgggggagggacttctccttcggcgatggacccggtggattacgtgaatccttatatgggaaacatcagccatttattggtgcctactttcccgaccgtgcatttgccgaacagtatgctacgtgtatatccggagcgtgcggacttcacgggcgatcgtctgggcggtttgcctattatcgtgacaaaccatcgtgagcgttctgcgttcaatttatgcccttatcaaggtgacgaatccggcttgcgacccgtgatcgcttatagctatgaccgggagaagatcttgccgtaccgttatcaggtatatctggataatgaggaaatcgacgtggacttcgccccgtcccatcaaagtgccgtatattcgctcactttcgagaaagagggaccggcttatctggtatttaacagccgtaacggacagctacaagtaaatggtaacgccgtaagcggttatcaatatatagataagaaaacgaaagtctttttatatgccgagacaaaccagaagcctgtgaaagcgggtgtattgtcaaacggcagtgtcaactataacgagacctccgtggaaggtaccaatgccgctatcgccctttccttcggggaggacgtgaagaaacttggcgttcgctacggtatctcttttatcagcgaggaacaggcgaagaagaatctggagcgtgagatcgccgcttacgacgtggatgtggtagcgaagatcgcccgcaacgattggaacgacgctttaggtaaaatacaagtacaaggcggtaccaaggatgagaagaccgtattctatacctctttatatcgttgctacgaacgcccgatttgtttgagcgaggacggacattattacagcgctttcgacggaaagatccatgaggatggcggacggcctttctatacggacgactggatttgggatacctaccgtgctacgcatcccctgcgtgtcttgatcgataatgagcgtgagaacgatatcatcaactcttatctcctgatggcggagcagatgggtaccgactggatgcctaccttcccggaggtgacgggagatacacgccgtatgaactcaaaccatgctgtcgctaccgtgatcgacgcttaccgcaagggcttgcgtgggtttgagctggaaaaggcttatatcgcttgtaagaaaggtatcgaggaaaagaccttgatcccgtggtctgccgctcccgccggttggttggacgatttctacaaggaacatggctatattcccgcgttgagaccgggagagaaagagacggtgcctaacgtatccatttgggaaaaacgtcagccgatcgccgtgactttaggaacttcgtatgatgaatggtgcttgtcccagatcgctcaagaattgggaaagaaagacgaggcggattattatttgcgtcgctcttacaattaccggaacgtatttaatccggagacaggtttcttccatccgaaagataaggatggcaagtttatctatccattggattaccgttatgatggtggtctgggtgcccgtgattattacgatgagaataacggatatatttatcgttgggacgtacagcataatatcggtgacttgatctctttgatcggaggcaatgaggcgtttacctctgctttggattccatgttcaatacgccgctgggtatgtctaaatggcaattctattccacgcttccggatcatacgggtaacgtaggtatgttctctatggcgaatgagccgagcttgcatatcccgtacttgtataattatgcgggtaagccttggatgacgcagaaacgtatccgtaccttattgaatcaatggttccgcaatgatttgatgggtgtaccgggtgatgaggacggtggtggtatgtccgctttcgttgtcttcagtcagatgggattctatccggtgactccgggttctcctacctataatatcggtagcccgatgtttaccgacgtgaaagtggatatgggtaacggcaatacgttcgagatccgtgcgaataacgcgtccgatgagaataaatacgtacaatccgctaagttgaacggcgtaaccttgaaccagccttggttcaatcatagcgatatcgccgccggtggtttgttagagttagagatggggccgaaagcgaataaggaatggggattgggaacgcctcctccttctgccgctccgatgcctaagtaaataaaaagcgtgttgcgattgtcgcaacacgctttttttatgccaataccttagcgattaatttctttagttcttttatatcaatgggcttcactacataatccgtgaattcacattgtttggcgatctccttttccctttcgaaagcgaatgccgtgagtgctatgatcggaatggtcttggataaggtgcggattctgcgagttgcttcgaatccgtccataaccggcatttttatgtccattaggattaggtccggatgatatgtctcgaacatatcgatagcctcttgcccgtttagcgcatgataaagttggtattgcttgccaaacaaggtttccaaaaggaaataattctcataaacgtcctcggcgattaagatggaatgatgcctatctgaacggggcgtttcttcggattggacgaggatatctggtgaaagctcaatatcagtccgttttgtgtccaaaggcagagtgaaccaaaaagtggaacccaccccttcttcagagtctacgccgattttacctcctaatgcctcgataatggttcggctgatggttaatcccaatcccgtaccttgctggaaagtatctaccttgatgaatcgctcgaatatacgtctttggttttccgcggagataccgatacctgtatctttcacgcagactcggataaaatccccttctatctcataataaatcgtgatacttccttttgtggtaaatttgatagcgttattcacgaaattggatatcacttgcataaccctccgctcatcggttttaacgattacggatggggagtcgagatcaaagatcagatccacgtctgaaggcatctttatagagtctgccaatgcgatttcgccacatatatccttgatgtccacttcctcgaaatgataatccatggttcccgcctcgattttagagaaatcaaggatatcgtcgatcagttgcagtagcaaatcattattcttatggatgatatctaaataagattgacgctctacctcatcatcaatctcggcgattatatttgagaacccgacgatagcgttcagcggcgtgcgtatctcatgactcatattcgccaagaacgcggacttcaatttatcagcttcctttaccttgattagctcgatctccttttcccgttgctgggttatgttggaggtgtagcttacgatcctgttaggcgttccgtcatcgttgaatttataggagcgtacattggagttgaaccagaatgttttgccattgaggatacgcctgtaagccgctacgaagttattgatcttcccttgcaggagaggtttgaactgtttattatatacccggtcaaaatcatccggatggattgaggatttatagtcttcttgattcttgaagttgtaatcatgaatcgcttttagcccctcattattattaatgtcttcattgaggccaaaatctacggtcaatttatcattctctacatcgtattcccaaagaatggaatccccggtatctaccgatacttttagccgggctaggctattttcgatttgttcccgcttgatgtgattctcggtatcgtcgaatacaatataaatatagccgaatatattatcaagagagtctttcaatgtgactccttttaccaacagatgctttgttttagaatcatgatgactatcgtaatagccgttttgagaagcaaccttgaagtcataattaagtggaaagaatatatcttttccgtttttgaggctttggtttacatatttcgggatattaggattctcgaacatattcagtcccacggcctgctcacgggtaacaccaaaaatatcgagatccgcttggttgatatctaccaacactccattctcatcataaagttcggcgccccaaggcatcttgtcgaaaatgatcttaaacttcgtctcgcttttcatgacttgcatagccgtatgttctactaatccttgaacttcccctctttcaatggctatggaaaggatatcagccaacatatgtaagttctctatatctaaggcactccagttccgtttcttttttacagaatcaaagccgataaatccggatggtttgccttgcttgaaaatagggatgactaataaggatgaaacctcttgcaaaatcagaagatgctgctcactcttcgcctcttccggcattttagagacatcatgaataacgatatccatgccctttttgatactatcgtaccaccaaggaatctcgtcttgcgggagttgacgcagtaaatcctctcgcatagagataatgccatcacaagtaacttcattcgtaaagtcaacagtatgagtttgttcgtcaaatgttccgatatacacccgatccacatcgaaaaattgtaagatgcggaatagcgcttggtcaataaccgagttttctttggctccaagaagaagtgacaatacatccgacatcgtttttcgcaaatcaatcatattggccaaaatcaagtcggtcttttcatcttctacatcggtcttcttgtctatagcctcattaagaaatgttgtattggaatgaatgttattcatgataaattgagtgtactaaatttattcgaaaacaaatgtaagtataaactttgattattttttgttttagtgtttattatattattatcgtggctttaaaaataattttgtacgtttgtaaatagttgaattaaacttgaaatctatggataataaaatcatattgacgataggccgccagttcggaagcggtggccgcgagattggacaacgtttggcgaaggagttgggtatcggttactatgataaggaactgattaccgtggcggcccgtgagagtggattatgcgaggatgttttcgagaaggcggacgaacgtgcctccagtggtttatcgtacgcttttacgatggggtactcttcttttatgggagggatgtttacgccttataatgatattttgtctaatgacggtctttttaagatacagagtgacgctatccgtaaattggcggagactgagtcgtgtgttttggtagggcgttgcgctgattatatcctccgggatgatccggcttgtttgagcttctttatccatagttcagtggagagccgagtccaaaagaccgtggaaaggcatggtgtgacagtggaagaggcgaagaacatgatggagaagactgataaatcccgtgcggcttactataattattatacgaataagacatggggaatggcctcttcttataatttctcgatcgatgtatccgtattagggatcgacgagaccgtggaatttatgaaaagctttatcgagcgcagattgaataagcgtccgcctcatttcggataaatcgtattcttgagaaaccattattgaatagagattaacctattaaaactaagaaagtatgcgaaaaccttttattactgttcggctgacccatggtatgttgggcgccttgttagtttccacctgtgcttgttcgggcacgaagtggacggaggtagagaaagattctatccgtatcgttacccagcaagaaggagctgtattaggatattccgccaattcgggggtgagacttcttactgttgacggatatgccttcaaagatctgaatcggaacgggcggcttgatccgtatgaggattggcgtcttacgcccgaggaacgtgccgttgatttggccggacagttatctacagaggaaatcgccggattgatgctttatagcgcccatcaatctatccccggtgcctcgaaagggtttggaacttctacctacaatggcaaatcttttgatgagagtggagcccagccatccgatctttccgatgcgcagcgtaaattcctcaccgaggataatgttcgtcatgtattggttacgagagtacaaagcccagaagtggcggctcgctggaataataatgtgcaagctttagtggagggcatcggtcacggtatcccagccaataatagttccgatcctcgccatggtacggctgcggatacagagtataattttggtagtggaggacagatctccttatggcccggttctttaggtttggcggctactttccgtccggaaatgatgagacgttttggtgagatcgcctctgctgaatatcgggcgttaggtatcgctaccgccttgtccccgcaagtggatatggcgacggagccccgctggagccgtgtgagcggtacgtttggagaggatccggacttggttacggatatgtctcgtgcgtatgtggacggttttcagacttcaaccggtgggaaagagattcgtgacggttggggctatgagagcgtaaacgccatggtaaaacattggccggggggtggaccgggtgaggctggacgtgatgctcattacggttatggtaaatacgccgtttaccccggaaagaatatcgaggaacaaaagaagccttttgtggaaggcgcctttaaattggatggagctaccggcaaagcttctgcggtgatgccttattatacgatttctgtcggactgaatccggatggtgcggatattgcgaatagttacaaccgttatctgattacggatcaattacgtgagaaatatggatacgacggtgtggtttgtacagactggggaatcacgggtgatgagacgggcatagagaccttcgccggaaaaccttggggagcggaggagctttctgttgccgaacggcattaccgtattttgatggctggcgtagatcagtttggtggtaataacgataaaggcccggtattggaggcttataagatgggtgtggaagagatgggagagcccgccatgcgtgaacgtttcgagacttctgccgtacgtttattactgaatatctttcggacaggattatttgagaatccctatttagaccctgccgaatcccaaaagatcgtagggaatcctgattttatgaaggaggcttacgatgcccagctcgcttctgtcgtgatgctgaaaaataagggaaacgccttacctatgagtaaggagatgaaggtgtatattccgaaacgttattatccggcggtagtcggtttcttcggaacgactagcgaggctcatagggatgatccagtgaatttggatttggttcgtaagtattttacggtcgttgataatcccgatgaggcggatttcgccatcgtctttatgacgagcccgaacagtggtacggggtatgataaatccgatcgtgagaaaggaggaaacggttatatgcctatcagtttacagtataatgattataccgctacctatgcccgtaacccaagtttggcggggggagatccgtttgagaatttcacgaaccgttcttataaaggtaagtccgtgaaaacagctaataagcaggatatgctttctgttttggagacaaaggctaaaatgaaaggtaagcctgtaatcgtatctttggagatggataagcccacgattatgtccgagttcgagggttcggcggatgccattctggtgaacttcggtgtacaaaaccaagcggtcttggatatcatcagtggaaaagccgagccttccgctttgttgcctttgcagatgccggcagatatgcgtatcgtggaggagcaattcgaggatgttccccgggatatgaaatgctatacggacagcgagggccatctgtatgatttcgcttttggtatgaattggaaaggcgttatcgatgatgagcgagtgactaaatataaatagggtaaattacatttttgtgtttttgtggttacggtatctatatataatgcctaaatttgcatggtaatattattaagtgcagaccatgaaaattatgacattgcagggaacggacaaattgttatatgaacttgtcgcgcctttggtcatgaatccagccattttgcgacaaaataacaattacccttttaaaacatctcgtagccacgtttggtatatagcctttcatgaaacggctgttgttggttttatgcctgtaaaaaaaggacatatctattactctatagacaattatttcgtgagtggtgacgatccttcggtattgagtgaacttcttgaagaagtcataaaggatttttcatctcaagcttcacttatggctgttgtgcataaacgtcatgtaaaagtgttctcacaaaaaaagttccagacatgtgttgagtggaaaaattatgataaaatgcattatttaccggaggtagagtcatgatgcgaagaatggatgtgtacgaggcgacagagaaaagattgaagatcatttttgattatttcgattacgtatacgtctctttttccggcggaaaggatagtggtgtactgttgaatttgtgtgtagattatattcgtagatacgctccgggacgaaaactaggtgtatttcatatggattatgaggttcaatacagccagacgaccgaatatgtggaaaaggtttatgccgctaattccgatatccttgatatttatcattgttgtgttccttttaaagtccagacatgtacatctatgtttcaacaatattggagaccttggagcgaggagtgccgggatatctgggttcgagagatgccccattcatgtctccgggcgaaagactttgacttcttcaaggaggacatgtgggattatgattttcagaatatgttccctttttggttgtatcaacggaaaatgggccggcgtatatgttgccttgttggtatccgtacccaagagagttttaataggtggcgagccatacatagtgataagaattacagaaaactagctaattataaatggactcgcaggatgaattattctatatataacgcatatcctatttatgattggaaaactcaggatatctggatagcgaatggaaagttcggttggccatataatcatttgtatgatttgtattatcaagcaggggtgcctttgtcccggcaacgtgtggcgagcccattcatatcccaagcgatatccacactgttcatttacaaagttgtcgatcccgacatgtggggacggatggttggacgtgtaaacggtgttggctttgccggtatatatgggaatacctccgctatgggatggagggctatcaagtgcccagccgggttctcttgggagaaatatatgtattttctcctaaataccttacccgaagaaacttgtgagaactatttgaataagttaagagtcagccgtaaattctggagagaaaaaggaggatgcctcagtgaggagactatcgctaagttacgggcggctaatattcctatcattgtggaagaatgtaccgcttaccatacggataagaaaccggtacggatggagtatatcgatgatatcaatatacccgagtttaaagaaatccctacttacaaacgtatgtgtgtttgtattttgaaaaacgatcatacatgtaagtatatgggtttttcccagacaaaacgagagagggatatgagaaaagaagtaatggacaaatataatttttataagcatgggaaactttgttagtccggcatatggtgttagggctgtccctatagaaaaaattgtagccaacagctataaccctaatatcatggcaccaccggaaatgcgattattggaactttccatttgggaggatggctatacgatgccttgcgtctgttattatctagaagagtatgatttatatgagatagtagatggttatcatcgttatctggttatgaagcaatctcaaaggatttatgatcgtgagaaaggaatgttgcctgtaacggtgattgagaaagatatttcaaaccgaatggcttcaaccattcgccataacagggctcgagggatgcacaacttggaacttatgacggagattgttacggagttggtcaaatcggggatgtctgataagtggatcatgcgtaatattggaatggataaaaatgagttacttcggttcaagcagatttcgggattagctgaattattccgggataaagaattcggttggtctgatgactggtcggaagaagactaaactttttacattttgtttgtctgagcgttttttgccttttatggctctgttgagtacatatatactaattttttgtacatttgcccccgacttttcacataggggtgcccgagtcatacgggctgagattatacccatcgaacctgatccgggtaatgccggcgaagggaaaataaggtagaactaggaaataaagggggcgttacctctatgtgctccctgatgtttaaactttaattagttattaagatggaacagattgtttcaagtggaatcattgactcttacttcgagaagttgaagagcaacttgtctgtggatgtagcgatcgtgggtgggggaccttccggtatcgtagccgcttatttcttggcgaaagccggtaagaaggtggcgttgtttgatcgtaagctggctcccggtggaggtatgtggggcggcgctatgatgttcaacgatatcgtggtgcaggaagaggctatgccgatcatcaaggaattgggcgtaagctataaggaaggtgctaacggcacgtatatcatggattcggtacataccacttccgctttgatttatcaggcgacgaaggcgggcgctacgatctttaactgctattcggtagaggacgtggtgtttcataacgatgccgtagccggtgtggtagtgaactgggctccggtaatccgtgaggggatgcacgtggatccgttgacgatcatggcaaaggctgtcttggaaggtacggggcatgattgcgagattgcccgtgtggtagcccgtaagaatgatatccaattgaatacaccgaccggaggcgtgatcggcgagcgttccttgaatgtggagctgggtgagcagacgacggtggagaacacgaaggagatctacccgggattattcgtttccggtatggccgctaacggcgtaagcggtagcttccgtatgggaccgatctttggcggcatgctgatgagcggcaagaaggctgctgagttgatctgcgaaaaacttgggaattgaaaattgagaattgagaattgaaaattattgattgttgtatctttaattttcaattctcaattcccaacggtttttccttgtctcaagaataagaatcccgttatgatcaacgccgtggataatcccgtatagaatacagaaatgaaagaattcggcagtaaatggagcgcacggatcgtgatcccgaaagcgatcatgaagatcatgataatccaacctttcacgtcgaagaaagagaacgggcaatgtttcccgtttttccgggagatccgttcggaatgtttatagaaaagccgtttaaagaccaaattgaagaaaagtaagaaaacgatggtcgcttccccgatcttgaataaccaataatgggtatcgtttaaccatgtgacgataccgatgcgtaagatattgataccggcgaaaatccatacgcaaccggcggtatataataatacctttttatttactccaaacttcatctatctttttatttaccgcaaacttacaacattcatgtaaaaaacggaaaaatatccttatctttgtgccatgcgtgagaaaatgaaacagagggttgtacaatacgtggtgctgatggccggcatcttggcattgctttctgtggttatccctcaccatcatcaccgggacgggatgccttgttatcaatccttgaccgcggagcaagcgcatggcgataaaagcactgatacgcatgattgcggttgcgacgggcataacttggcctatttcagtacgcatatttctcattttatggatggagatgtggatatacatctgatgccgttactcgtcttatttgattacatttatccacctgaaccggcgttttgcggacagctccttgatcacgagaacgccccctacattgagtcgctgcacgacacttggatagtgagtgcctcgggacttcgtgcccctcctatgtcttgatacctcgtttgtgagagtgggtgaggacagacttgcccctatctatttattattaacgatatcaagattttttacacaatgaagaaaatatatttggtaggtgcgatgtgcgcttacctgtttgccggttgtgcgggaaatgcgtcgcaagccggacacgatgagcataatcatgaattagaggctcacgaccatgagcatgaaggtgaggatcacgatcacgatcatgatcatgagggacatgaacacgaaggccatgaccatgagcatgaggctggtggtacccatcccggcgagattgtctttaagaaagccttagccgaggccgttggtttgcagaccgtaacggttaatcccgctcctttcacggatgtgattaagacgagcggacgagtaatggcagcgcaaggggaggagtccgtgatcgtcgctaccgtccccggcgtgatctcgtttggtagcttgccattcgtggatggtacggcggtacgcaagggacaggccgtgttgagtatcgcttccaacgccctctcggatggagacgtggcggcaagggctaaattcgcttatgagacggcgaaaaaggaatacgagcgtatgcaagccttggtaggcgataagatcgtatccgccaaggatttcgagcaggcccgcttgaattacgagaacgccaaggtcgcttatgaggcgatagcgggaaaacagacggcgaaaggcgtgtctgtagtctctcccttgaatggttacttgaagaacatccaagtgaaagagggtgattatgtatccgtaggccagcctttggctacgatctcgcaaaacaatcgtttggtattgcgtgcggacgtgtctgagaggtattacaacgatcttcccatgatccaaaccgctaatttcatgactccgtatgataacgctctctataaattgtctgatttgcgtggacggttgttatcgtatggaaaggcttccgatatgaactctttctatgtaccggtgactttcgagttcgataataaaggagcggttatccccggttctttcgtggagatctttttgttgacaaagccgatggagaatgtcttgagcgtgcctgtctccgcccttatcgaggagcagggcgtttattcggtatttatccgtctggatgaggaaggctataagaagcaatgggtgacgctgggagcgaataacggctcggaggtacagatcctttccggattgaaaccgggcgatgaggtcgtgactcgtggcgcttaccagatcaagttgtcttccgcttctaacgcgataccggctcatagccatagccattaataggagggacgttgcatgttaaataagataatttattattcattgcacaaccggttggtaatcttggtttgtgcgctattgctgatgatctggggtacgtacacggcgtttaatacggacgtggatgtgttcccggacttgaacgccccgacggtcgtgattatgaccgaggcgaacggtatggctcccgaggaggtggaacgcttggtgacattccctgtggagactgccgtgaacggtgcgatggacgtgcggcgtgtacgttcctcgtctaccaccggattctccgtggtttgggtagagtttgattggggtacggatatttaccgggctcgtcagatcgtgtccgaaaaactggctgtcttgggtgagagccttcccgagaacgtaggtaaaccgaccttaggcccgcagtcatccatcttgggtgagatgatgattctcggtttgaccgccgattccacgtctttgttggacttacgtacgatcgccgactggacgatccgtccccgtttgttgtctacgggcggtgtggcgcaggttgccgtgatcggtggcgatattaaggagtaccagatcttgttggacccggctcgtatgaagcactacggtgtagggttgaacgaggtgttggatgtttgtcggaatatgaaccggaacgccaatggtggtgtattgtatgagtttgataatgagtatatcatccggggagtcttgtctacgtcgaaggcggaagagatcgctcagggtgtggtgaagaccgtgaatgagtatccggttacgctgggtgatatcgctacggttaagatcggcggtaaaagcccgaagctgggaaccgcttccgagcggacgaagccggccgtattgattaccgtgactaaacagccggatacgagtacggagaagttgacggagaagctggacgagattgttgtcgatttgcggaagaacttgccggtggatgtacatgtctctacggatatattccgccagagtcattttatcgataactctattaataatgtaaagaagagcttgtttgagggtagtttcttcgtggtgatcgtcttgttcctgttcttgatgaatatacgtacgacggtgatctcgttggtagccttgccgttatctttgctggtctctatcatcgtattgcactacatgggattgacgattaacacgatgagcttgggaggtatggcgatcgctatcggttccttggtggatgacgctatcgtggacgtggagaacgtgtataaacgaatccgggaaaaccggctcttgcctccggatcagcaacgctctaccttggaggtggtttacgacgcttcccgtgaggtacgtatgccgatcttgaactctaccttgattatcgtggtgagcttcgtgcccttgttcttcttgagtggtatggaaggccgtatgttggttccgctgggtatcgcttttatcgtggcgttgtttgcttctacggtggtggcgcttaccttgaccccggtgctttgtagctatttgctgaaccgtaaagcgacgggaatgaaggaactgcgtgaggcttggatagcccggaagttgaaggtggtgtataaacgggctttggagttagcgttggcttaccagaaatgggtgctaggtaccacgatcgctttgtttgtggtcgccttggtgatcttctttcatttgggacgtagtttcttgcccccgttcaatgagggttcttttacgatcaacgtaagctcgcttccgggaatttccttggacgagtcggatcagatcggacgccgtgcggaagcgttgctgttgcaagtgcccgagataaagactgtggctcggaagaccggtcgtgcggaattggatgagcatgccttgggcgtgaatgtttccgagatcgaggctcctttcgaattgcaagaccgtagtcgggatgaggtgatgaatgatgtccgcaagaagttatctacgatcagtggcgctaatatagagatcgggcaacctatttcccatcgtatcgacgctatgctttccggtacggaggcgaatatcgctatcaagctgtttggtacggacttgaacctgatgtttacggtcggaaaccagatcaaggccgctatccaaacgatcccgggtctggtggacttgaaggtagagcaacagatcgagcgtccgcagttgacaatcaccccgaaacgtgagttgctggctaaatatggtattcccctgccggagttcgaggaatatatcaatgtgatgttgggtggagaggccgtaagtcaggtgtacgacgatggcaagagcttcgacctgaccgtgaagacctccgacgctagccgtgccacgatggatgatattagtaatctgatgatcgatgccgccggacagaaagtgccgctaagctacgtggccgatatccgttccgtgaccggtccgaatacgatcaatcgtgagaatgtgcaacgtaagatcgtgattagtgccaatgtatcggaacgtgacttgcgaagtgtggttaatgagatacaggatcgggtagaggctaatatccgtttgccggagggataccatatcgaatatggtggccagttcgagagcgaggcggcggccagccgtaccttattgctgacgtcattgatgtcgttattggtgatcttcatgttactgtacaatgagttcaaggacgtgaaggagagcggcgtgatcttgttgaacctgccgttggcgttgatcggtggcgtgattatcctatggcttacttccggcgagatcagtatcccggcgattatcggtttcatttccttgtttggtatcgctacccgaaacggtatgctgctgatcagccactatacgcatttgcgtggagagggaatgggattgcgtgagtccgtgatacaaggttccctagaccgtttgaacccgatcttgatgacggcgttgagttccgccttggcgttgatcccgttggcgttgaatggcgatcttcccgggaatgagatccaaagcccgatggcgacggtgatcttgggtggtttattaacctctacgttcttaaacggattcatcatcccgattgtttatctgataatgaacaagaataaagaataagttttatgaaatcatatattatagtcgccgccttgtctgtattgacaggcggcctttccgcccagacttctatagaggacgtgctccggagcgtggaggcgaacaataaggatttacaggcgaacagccagttggtccagtcgcagaagctggaggcgaagttggataataatttgccagacccttcggtctcttattcgcatttctgggggaataaagaagggatgggattcacgggcgagttcgtggcttcccaaagctttgatttcccgtccgtatatgtccggaagcataagctgacgaaggcgaaatccgcgggtttggatcgtcaagggatggcttttcgtcagcaaatcttgttgcaggtgaaagaggtttgcctagatttggtgctgttgaaccagcagaagaacctattggatacccgtcttaggaacgccgagcaactttccgctttttatgcgactcgtttggagaaaggaaatgcgaatatccttgagacaaacaagatcgatctggaattattgaacgctcggacagaggcccggatgaacgagacttcccgtattgccaagctgcaggagctagctaccctgaacggcggtatcgctatcgagtttacggatacggtttacgccttgccggatagggaggtgctttcctttgatgagctgcggacggaggcgatgcaatccgatccgcaattacagaccttgcgtagcgaccagacgacagcccttcggcaggtgagcgtgaataaggcaaaaggtctgcccggctttgagttagggtatcgtatgaatcccgcctcgggtggagagcgtttcaatggtttcttggtaggaatcaccatcccgttgttctcgaaccgtaataacgtgaaacaggcgaaggctcaggcccgctatacggagatgcagttggagagcgcttctttcacggtagagaatgggttgaggcagctatatgaccagtctgtctccttaaagaaatctatcgatgaatataaggatgtgctgaaaaggcagaatagcttggtcttgttgaacaaggctatacaggccgggcaaatctctatgatcgagtatttcgtggatgtgacgacctattaccaaagcgtgcaaaactacctgcaattgcaaaaccaataccaaaaggtcatggcgcaattgtataagtatcgattatgataaggaacacaactgtgttttctcttgaacacagttgtgtttatccacagatacagttgtgttttctcacgaacacaactgtgtttttacgttctctaaggatagcttaaagtcccggatcaattctttcatcacctcttccacggataattcctcccagaataaagacgctacctgtccgatctctaactcgccttcctttaggtcgccctcaaagattcctttcttggcacgtcctttgcccaataactcacgtaattcttccacggacgctccccgggcttccgcttcttccactgccgtagcgaaatctccttttaccagacgggtaggagacagtttctttaataataacttcgtatcgccttccttaagattcaagcatagtttcttgaaattctcgtgtgccgagctttctttggttagggcgaaacgagtgcctatctgtacgccgtcggcccctagtgcgagtgccgctagcatcgcttgaccgtttccgatacctcctgccgccaaaagggggagggaggtcgctttccggacagcggggatcaggcacatcgtagttgtttcctcccgtccgttgtgcccgccggcctcgaagccttcggcaacgatggcatccactccggcctcctcgcatttcgtggcgaatttagagctgcttaccacgtgaacgaccgtcatgccatgatccctcaaatactttgtccatgttttcgggttgccggcggaggtaaatacgatcttcactttttcctccaccaatatccgcatcaaggtatcgatttccgggtacatcagcgggacattcacgccaaaaggcttgtcggtcgccgcctcgcatttacggatatgttcccggagcacttccgggtgcatggagcctgccccgatcaatcctaatccaccggcgttactaaccgctgaagctagccgccaaccactacaccaaaccattcccgcctgtatgatgggatactgaataccaaaaagactacaaattcgattcatattatttcttgcgttaatctcgctaaaattagtgaactatttttattggaacaacaatttctttgtcgaggttgttgaataggcatataactttaaaatataagagatatgccagagaatataatgaaaacgttatgggatgagagcgatgatcttcacgatgagaccatgtctaccaattcggtattgtcggatgattacacgtctaatgacattcaagatttacaagaaacgatcgaaaatgaaaatatcgaggacggtatagagagcgattcgattgaacattgaatgaaagcatattgggtccccgaagggaagatctccctttggggatcttttttgtgtgaattgtgaaaatctttttccggattctaaataataacaatttgaaatagaattgtaacgcaaaacttcgttatctttgtccattgtaattctaatataacaatggcatgaataaaacgcttatggccgcaggtttagcggttattttgggagcttgttcctcctcaaagaaaagcgatgtagcggaaggcgctacacccaatccgttttttgcggagtatacgacaccgttcggggtgcctccgtttgaccaaatagaggtggctcattacaagccggctcttttgaaaggcatggaagagcagtcgaaggagatcgaggcgatcgtggcaaatccggatgcgccgacattcgagaatacgatcgtggccttagaccaaagtggcgagttgcttactaaagtaatgtatgctttcggtggccaatccagtgtgaataccacggacgagatccaagagctcgaacgtgagctttatccccttttatccaaacattcggatgatatcagcttaaatcccaagcttttcgcccgggtgaaatccgtatatgagaatcaggcgagcttccatctggataaggaacagaagaagctgttggaggaaacctataaaagctttgtccggggaggagccaatctgccggaggataagcaggcgaagttgcgtgagctgaatgagaagatatccatgctccaacttactttcggacagaataccctgaaagagaccaacgctttccaattagtgatcgataataaagaggacttatccggcctgccggaagacgtgatcgtcaaggcggcgcaaacggcccaagagaatggtctggatggtaaatgggtgtttaccctccataatccgagcgtgatgcctttccttcaatacgccgataagcgtgatttgcgagagaagatcttcaaggcgtatacaaatcgtggcaacaataataatgagaatgataataaggaggtcgttaagcagctggttaccgctcgtctggagaaagcccgattgatgggatatgaggattatgccgctttcgtattggaagagaatatggcgaagaacgagaagaacgtgtacgacttgctcgataaaatctggccgtctgccttggcgaaagcgaaagaggaattggccgatatcaacgccgagatcaagaaggaaggtggtaattacgaggccgagggctgggactggcgttattatttcgagaaagccaagaaagcgaaatataacttggacgagaacgagatgcgtccttattttgagttgggacatgtacgtgagggcatcttctatgtagccaataaattatatggtatcacgtttaccgagatcaaggacatcccgaaaccggaccccgacgctctcgctttcgagtgcaaggataaagatggtacgcatctgggcgtgctgtatatggatttctttacccgcccgggcaaaggaggtggcgcatggtgcggcggttaccgctcacaaacgtataaagatgggaaacgggtagccccggtggttactaccgtatttaatttcagtaaaccggcggagggacaaccggcgcttttgacagccgacgagaccgagaccgtattccatgagttcggtcatgccttgcacggtttattctgcgacgttcattattatggcgtgtccgacgtgcctcgtgactttgtggagctaccttcgcaagtcgatgagcattgggccgttgagccggaggtattgaaagtgtacgctaaacattaccagaccggcgaggtaataccgcaagcccttgtagacaagatgatcaagagtggcaagtatggacaaggattcgctacgacggagtatctggccgcctcttatctggatatggattatcatgtattgaaagagatccctgccgatttggatattgagaaatttgaggcgaaggtcttgggcgatcgtggtttgatccgtcagattccgtctcgctaccgctctacttatttcggacatacgatggaaggtggatataccgccggttattatagctatatctgggcggaagtgttggattgcgacgctttccaagcttataaggagacgggtgatatcttcaacccggaggttgcctctaaattccgtaaatacgtactgaccccgggcggcatcgatgatgctatggatatgtacgtgaatttccgtggtaaacaaccaagtatcgatccgttgttggagaacagagggctaaaatgagaagaataattagaataattcataactcataaatcaaaaaatcagtaaagatgaaacaattaattatggcagcaggattagccgttatgcttactgcctgcggtacttccgaaaagaagaccgtggagggtgagaacccgttctttgcggaatataccaccccgtttggagttccaccttttgatcaaatcaagttcgagcactacaaaccggccctattgcaaggtatggaagagggacgcaaggagatcgaggcgatcgtgaataacccggaggagccgacgttcgagaatacgattgtcgctttggatgagcagggtgcgttgcttcggaaggtccagatcgttttcggtggacagaatagcgtgaatacgaatgatgagatgcaggcgttaagccgtgagatgtcgccgctattgtcaaaatatagtgatgatatcaacttgaatccgaaattattcgctcgtgtgaaggcggtatacgataagaaggatgagttgggtctcgataaggagcaaatgaagttattggaggagacttataaggacttcgtcaggggtggcgctaatctttccgcagaggatcaagcgaaattgcgtgagttgaatagcaagatctccatgctacagcttactttcggacagaatatgctgaaagagacgaatgcttttaaattggtgatcgacaagcaggaggatctttccggtctgcccgagaccttgatcgctaacgccgctcaagcggccaaggatgccgggatggaaggcaaatgggtatttaccttgcagaacccgagcgtgatgccgttcttgcaatattccgataaacgtgagttgcgtgagaagatgttcaacgcttatatcaaccgtggtaataataataatgagaacgataacaaggaagtggttcgtgatttggttgccgctcgtttggcgaaagcgaagttgatgggctatgatgattacgcttctttcgtgttggaggatcgtatggcgaaaagctcggataaggtctatcaattgctagacgaggtttggaagcctgctttggcgaaagcgaaagaggaattggccgatataaacgccgagatcaagaaagaaggcggcaatttcgaggccgagggctgggattggcgttattatttcgagaaggccaagaaagctaaattcaatttggatgagaatgaggttcgtccttacttgaagttggataatgttcgtgagggtgctttctatgtagctaataagttatatggtatcacgttcaccccgatccgtaatattccgttgccttatccggaagcgcaggcttttgagtgcaaagataaggatggctctcatttgggcgttatttatttcgatttcttccctcgtgccagcaagcgtggtggtgcgtggtgcggttcttatcgtccgcaggcttataaggatggcaagcgtgtggctccggtcgtaacgatcgtttgtaactttagccagcccgctccgggacaacctgcgttgttgagcgctgatgaggcgaatacattgttccatgagttcggtcatggtttgcacggcttgttccgtgacgtgcattactccggtgtttccggtgttcctcgtgatttcgtggagttgccttcacaggttatggagcattgggtattcgagccggaagtattgaaggtgtacgctaagcattatcagaccggcgaggtgatcccggccgagttgatcgagaagttggataagagcggtaagtacggacaaggtttcgctacgacggagtatctggcggcttcttatctggatatggatttccatgcgatcagtggtgatgcggcggataagaaagtgatcaagttcgttgaccagacgaataatgttccggccaacttgaacgtgatggatttcgagcaacagacgttaggccgtcgtggtttgctgaaacaaatcccttcccgttaccgtacgacttacttcaaccatacgatgggtggcggctacaccgccggctattatagctacatctgggctgaggtattggattgcgacgctttcgaggcattcaaggaaaccggcgacatctttaatcaagaatgtgccgataaattccgtaaatatgtcttgaccccgggcggtatcgacgacgctatggatatgtacaagaatttccgtggcaaggaaccgggtacggatccgttgctgaagaatagaggactgaaataatctagaaatggagattttataaaggcggaccggttggttcgcctttttttgtatatgctcaacctcccggatctgtattacatttgctaagttttatcacgaaaaaatagcgatagtatggagaaaaaggatttagtagaagggatgaggttgtatatctataaattgcgtgtggatgggcgttattccacggcgaagagctatcaggatgcattgaactcattcatgcggttttgtgggttggaggtaattccctatatctatgtcaataaggagaaccttcggcgttatcaggcctttttgttgaataaaggatgtacatggaacacggtgtcgacctatatgcgtcggatccgttgtgtgtacaacatggcggtggaggaagggttggccccctatatcccttatttatttaagggagttttcacgggtatagagagcaaacgcaaaaaggcgttaccacaggatttattacgttctctgatgacggcctcattagatgatccggaactgagaaaaacacggcaggcattgtgcctgatgttccagttttgcggtatggcattcgtggatttcgctcatctgaaaaaggagaatgtccggggtggggttttggaatataaacgccagaaaacgggtactccgatgcttatagaggtacaatctaccgcatgggagtcgctgagggaactgtcaagtgatgtaggtaaggactcaccctatttgtttcctttcttgaaagggataaaagtgggaaaagaagcctacaaggagtacacttccgctttggcccattttaaccggaatttgaagaggttggcgagagcctgcggtgtgtctatcccgatcacctcatattcgatccgtcattcttttgcgatgattttgaaggaacaggatgtcccgattgagatgatcagcgaactattgggccataaatcgatcaagactacgcaaatctatttgaaaagtttctcgttggaaaagatgtctgcggtgaataaaatttgttttgagagtgtgtacaatcatgtaccgaaagtagggtaaagggagtaggctacttggggagtagccccggtggtctccaatgggcgaagaggctcatggcgtggcgtttctcctcggggggggtcgttgatcaatctccgctcttgcagggattggtagacatgggcggggtagagacgttccagtgggtaaccggccttgtattgctggaataccttgcggaggaaggcaagctcacgctctttcttgtaggccgtgatataatagccattggcatagatgtcacaaagcagggcaatatataatgaaaagcgtcagatccgtatttgcgctttatttgacggattttacggttgcttagtaaatctgtgtcgagcgggaaataatccggctcctttttaataggtcgtgccattactccttcttttccggatatccttgaatcagaagaattttacaataagcagaaaatgaggttttgtttgcaaggggttgaaaatcagagtcgtaaaaaacatcgtaatgtttgcgttaaaacacgtacatgtttttccgaaaagtcgtacatgtttttggatattcacgtacgtgtttttccggaaatgatattgatgtaaaataggaacattaaaaaatacaataaccttacctagtgagattctgtcacaagagatattccgggcattttatggttagatcgatttgggtgcggttttcctattggtatccgaggacgatgtggattttggatattttctattatctttgtcacttgaaagtgtattatcaattcaaaatgtaaataatatcatgagaaaattattgttagccttttgtgcgttcgcaacgatttgtagcgccggggcgcagtggaagcccgccggagacaagatcaagacggactgggctgagaaagtagatccccggaatgtattgccagaatatccacgccccgggatggaacgtgcggattggcagaatttgaacggcgagtgggaatacgctatccttccaaaaggacaggcagagccgacgagtttcgatgggaatatcttggtgccgttcgccgtggaatcctccttgtccggcgtgcaaaaagaagtgggggagaagaatgagttgtggtataaacgaacctttacggtgccctcctcatggaaaggaaaagatatcttgttgaacttcggcgccgtggattggaaagcggacgtgttcgtgaatgatatcctgatcggttcccacacgggaggctttaccccgttttccttgaatatcactccctatctgaatggcaaaagtacgcataagctggtggtgcgtgtatgggacccgagcgataaaggctaccaaccccgtggaaagcaagtggccaacccggagggaatctggtatacgccggtcaccggaatctggcagaccgtatggctggagccggtcgcttcctcgcatatcacctctatcaaggcgatcccgaatatcgataatggcgtgatgagcgtgacggtcggggcttgttccgactccccggtgtcggacatcgtggaggtcagcttgctcgataaggggcaggtggttgctaccgccaagggcgtacaagggacagaattacgcttggccgtgcaaaatcctacgttgtgggaaccttccaatccttatttatatgatatgaaggtgagcttgtcgaagaatggcaagaaggtggacgaggtgaaatcgtacaccgccttccgtaagatatccgccgagcgtgacgccaacggcatcatgcgtatgcgcttgaacaacaagaacctgttccaatacggcccgctggatcaaggctggtggcccgacgggctttacacggctcccacggacgaggcgttgctgtatgatatcgtgaagacgaaagcgtggggcttcaacatgatccgcaagcacgtgaaggtagagccggcccgctggtactatcattgcgataaggaaggtatgctggtttggcaggatatgcctagcggcgacatgggtaaccaatgggcgcctcatacgtataacggtggaaccgacaaggagcgtaccgaggagtctatccgtaattattacaaggagtggaaggagatcatggacctgtgcgtttcgaatcctagcgtggtagtatgggttcccttcaacgaggcttggggccagttcgataccgagaaggctgccgagtggacaaaaacatacgatccttcccgtctggtgaatccggccagtggcggtaatttccgtgcgtgcggcgatatcttggatttgcataattacccgggtccggcgatgtacctgttcgatccggtgcgtgtgaatgtattgggcgagtatggtggtatcggcttggctgtggagaaccatttgtggtggaacaaacgcaactggggctatgtacagtttaagaatagcgatgaggtgaccgccgagtacgtgaagtacgccaaggagttgaaggcgatggtcccgaagggtttctccgccgctgtctacacgcaaaccacggacgtggagggcgaggtgaacggccttatgacctacgaccgtaaagtgatcaagatcaacgaggccgaggtgcgcaaggcgaaccaagaggtgatcaaggccttgtctgagtagaaggcttagaaaaaatagttatttgactcgatgatagatccggtccgggcaaagagagattctttcccggatcggattgttttagcgaaatgaatatgattcggaatgtgagtttgcgagacgccaaggcgatcgtggatatatacaatgaatatgtcgtgaatagcgtggctacgttcgagacggaacctttgcgggtggaggagatggatggtcgcatagccgggatctcggcgagttatccttatctggtatacgtagatcatgatgaggtcgtgggatattgctatgcccatgcgtggaaagaaaaggcagcttataaatatacgcttgagaccaccgtttatttatccccgagatacaagggcaaggggatcggccggcagcttatggaaaggctgatcgaggaatgtcgggcaggcggctaccacgccttgattgcctgcattaccgaggggaatgaggctagctgctcgctgcatgagaagctggggttcagaaaagtatcccacttcgagaaagtagggctgaaattcgggcggtggctggacgtggtagattatgaattgataattaagcctaacgagaggtaactttcgaatctcaattttcaattctcaattaatatacctatcttcgcgataaacaaaatgtaaagaatgaaatacaatacagaaggaaaaagattgactttgcccgaatacggacgcaatatccaaaatatggtggactattgcgtgactatccaagacagggaagagcgtaagcgttgcgccaacacgattatcaacattatgggaaacatgttcccgcacttgcgtgacgtaaatgactttaagcatatcctctgggatcatctggcgatcatggccgattttaagctcgatatagactatccgtacgagatcatcaagaaggagaacctgtatagccgtccgcctcgtatcccgtacaacaataaccgtatacgctaccgccattacggaaagaccttggagctgatgatccgcaaggccacggagctgcaacccggtatggagaaagaccagctcgtgcggctgctggcaaaccagatgaagaaatcgttccttacttggaacaaggaaagcgtggacgaccgtaagatcttcaaggatctggacgagctgtctagcggcaagatcgtattgagcgaggaggaacacaaattggccgagagccgtgatatcttggcccgtaataacagtggcggcaacaaaaggaactttacgcgtaaaggcagatgagctcgttcgttatagaaggtggttatcgcttgtccggcgagatcgttccgcaaggcgccaagaatgaggcgttggaggtgatctgcgcgacattgctaacaccggagaaggtgaccatacacaatgtgcctgatatcttggacgtgaataacttaatccagctccttagggatatgagggtcaaggtggagcatccgtccgccgatacctatacctttcaggcggacgacgtggacatggagtatttgagtaccgaggagttcctgcgcaagagtggtagcctgcggggttccgtgatgatcgtaggcccgttggtagcccgcttcggcagggcgctgatcccgaaaccgggtggcgacaagatcgggcgacgccggctggatacgcacttcgtgggaatccagaagctgggcgcttgctttagctacgacgccgggcggcaagtatacgagatagaggcacgccagttgaaaggcgcttatatgctgctcgacgaggcttccgtgaccggaacggcgaatatcttgatggctgccgtgctggccgagggggtgacgacgatctataacgccgcctgcgagccttacctgcaacaactttccacgatgctgaaccgcatgggagcgagaatctcaggtgtcggttctaacctattgacgatgcaagtatcgaagaaacgcgtacctttgcaaatgactaaaagaatcgatcgtttatactagccgtttctatctattatataatgtacgcatgtacattatatatggtatccatccataaccgcataataaatacaaaatacaaacattcacatgcaatcattgcaaatactacaaacgtataatccaaggcttgtcaagccataagcttacgagttgagaagtgattagttattcacttggagaactttatgctagcggcttagtctattatttaatgttatctttatacgtgaaaagaataagtcaaccataccaaatttgatctcttaaaaagtacaataagcctaatatttaaagattgttatttatagctctgataatcagcgtataataagaattgatcaaaatgggagccgattactatccatagcattttgcactactattaatactaatcgtactttctataaatagtaaagctgactaccatgaatctgctttttaagaaatatacaataaacaggatgtgcgatacgaaaataaaccttacctttggagcagtaatcacctaaaaccatttaactatggcacaatacgtagacatcatgactgatgctggatttaaggctgtcttccaagacaagcaagttaccatcaagttccttaacgccgccctagccggcgaacggcagatcaaggacatcacctacctcgacaaggagatcaagccagagaccgtcgagaaccgtaccatcatattcgacctgctctgcgaggacgtgtccggggccaagttcatcctagagatgcagaattgtccccagcactatttctttaacagaggtttttattatctttgtcgcatggtggcccggcaaggacaaatcggcaagcaatggcaatatcggttgctacccatctacggagtctatttcttgaatttcaagttgccggagttcacagacttccgtacggatgttgtcctcgctaacgagaggacgggaaaggtgttcaatgagatcaagatgaagcagatctacatatcgttcccgttattcagtttaagcaaggaggagtgcaagagctccttcgaacgttggatttatacattgaagaatatgaacctatttgaacaatctcccttcaaggaggaacaagagaccttccttcgcttgctggacgtggcgaacgtcaactcactcagcgaaaaagaacgtgcgatctacgaggaaaacctaaagaattatcgggattggtatgcgaccatcgattacgcacaaacggaagggattgaaaaaggaatgcaggaaggaatgcaaaaagggatgcagaaagggatcgagaaagggatcgagaaaggccgtcaagaggaaaaactccagatagcccaaaagatgaaggagcaaggacttgactccgaacttatcgcccaatgctccggactttctgttgaagacattgagcgactataacccgaatcaaccgattcgattcaattcgatccgggccgcttccatccactatccggaggaaacggcccggattactttcgtacattcacgatacctagaaagcgtaattaaaatccaacggaataaagaaactgacgattgttccgctccccatccccttctccttgctttggaccgaataagtgatcttctctttatttctcctattcaacaataggatcgtacggtaaaggactttcgttcccatccccgtaccgttcgtatgtcccgcattcgtaaacggacgatacccgggtccattatcctctatacggatatggatgcctttcccgtcgcgctccacgaaaacagataatcgcttctcgccctcgatcgcacacaagccatgtttcacggcattctctacgggtatctggatcagcatggccgggagatagattgcgtccgtgtcaagggagggatcgagattccattccagacggaagtccggccctaatccttgcgcctgcaaattcaagtaagtccggacaaagcgtaattcttcctccaacgtgatactaagcttttccgtgatctccaaactactacgtaacaactccaccaatccggaaagttgcgtacggcgggaacttccttcttcctccgagctaatctcccggttcaatatattgaatataaaatgaggggatacacggttgcgaatactctccatcttcagtttcgtcacctgatcgacatggcttaaccattgggcatgccgtttacgtttcataaagtaataagccatgccgctgacgatggacaaaatcacaaaaagcaagatccaaacccaacggctcatttccaagtattccatccggccggcctgttgtttaataatagcctcccgcttgagtaaagtcgtatcttggctataacgcatatcgatctcggcgacacgcatctgggttcgttcgctacgaatattgttctcaatgacgctattcttcgtttggtactcataggcacgtctaaaatcgcccgtggtagcgaagtaattctgcaagttcttattacggatcgctaccatcttgggatctatgcctaccgtatccgtgtaactcctcaacaattgataagccagcccggagttcccctcttttaaggctagcgaagccttcaaggtcgtcaaatggtacaaggctgtcttattattataggtatggaagtacctaaaccctttttccagataaaaacgagcggaatccaactgatccagacatagatagatctcccctaaattgatctcgcatacgttagtatagaaatccatatgagtaggacgtaccacctcacgggctttcaagaaccaaggaagcgccttcgcatactcttccttgtaataatagtaatttccccggctattgcaaaaggtgaatttctcgctcaagttacgagaatccagttctttctccgccaaacggtaaaagtgatcggataagtcaaagtccctcaattccatatacgtctcgcccaaaccaaaataaataggaaaggacatccgatccataatacccaatgaatcactcacgaaaagagcttggcgaaagtagcgggctcgctgatcgtaagctcctttccgggtatatatatccgctatattgatataaatatccgggattttatgctccatctcactctgccggatctcttgatacgcctcggaatagcaaaggagggccgaatccgttttatccaaaaatgaataataattgccaaccgtatttttcaacgtccctaagagtccatgtatcttgggagacatcggtacacggtcgcaataatctataattgaccgatgtaaaacaaacccggaatcatatacactatttgcaaaataaatctggcttttaaccgcaagtaatttataatatttatcgctatctttagttagacttaaagcttcatccaatgcggaatgagcatatcgaggattccggtaaatcgaatccatagccatatgttccaaagagtcaatccgcaggttatcagaaaaagcaaatgttttttccggtagctttccacaagaaaacagaaacacaaaatgaaatagcaataataaaatggacataaaagtcatacacaccctatatttcgtcatcatcttggcggttttaaagttcatatgcaaaaatatttaaaaatttaatctacgcaattatttctcctaataaatatcgaaaatcgattacatttgtaaatctaaaatagagtacacatgaaaaacttgatgattcctgcgctggcgttatttttatcggcggcggcgcaagcagacgacagtccgttatggatgcgttactgcgcgatctccccggacgggcagacgatcgcgttttcttaccaaggggatatctacacggtcccttcttccggaggaaaagcccggcagttgacaacacatccggcgcatgatacccgtccggtctggtcgcccgacggacagagaatagccttcgcctccaaccgtagcggcaacttcgatgtatttctcatgaacaaggagggaggggaacccaagcggctcaccacccactccacaaacgaatatcccactacctttaaggataacggacacatcttgtatctggccaacgtattgcaagacgccaaggatatccaattccccggcacccgctttatgcaagtctatgagataagcacggacggaggaaggccggatttatattcttcgttatacatggaaaatatagccctcagcaaagatggcagtaaattattatacaatgactacaaaggttacgaggacccttggcgcaagcatcatcaatcttctatcacccgtgatatctggttatgtacgcttggaaaagatcgctctttccagaaagtaaccacttttggcggtgaggatcgtaatcctgtatgggccgcggatggggcgtctttctattacctaagcgaggagaaaggaagctttaacatcttcaagaaggatttggcaggcaacaacgagaaacaaatcacgacgcataccacccaccccgtgcgtttccttacctccgataattccgggactctatgctatagttacgacggcgagatctataccgttaaggaaggtcagaaacctgccaaggtgaatatccagatcgtcgcggataagatcgagaacgacgtgatccatcgtcttctgaccgatggaactacggatatcgccgtctccccgaatggaaaagaggtagcgtttatcactcgtggcgatgtttacgtaacttctattgaatacgagacgactcgtcaaatcacgaacacgccgcaacaagagcgcaatatagatttcagtcccgacggacgttcattggtatattccgccgaacgggaaggaacatgggggatctacgaaagtaaacttacacgtgacgaagataagcaattcacgtacgccccggaattgaaagaggagcctcttgtcgtctccggacaaacctcgttccaacccttatactctccggatggtaacgaggtggctttccttgagaaccgaaccaccttacgtgttatcaaccgaaagaccaagcaggtccgcaccgtattggacgggaaatacctctattcgtatagcgatggagaccagcatttccaatggtcgccagacagcaagtggttcttggttgattacatctccatcggaggatggaacaatacggatatcgccctcgtgaaagcggacggtagcggcgaggtaacgaacctgacggaaagcggttattcggatggcgacgcgaaatgggtattagacggtaaggccatgatctggtcctccgaccgtgccggtttccgcagccacggtagctggggtgccgagcgggatgtgtacatcatgttcttcgacggtgaggcttacgataaattccgcctcagtaaagaagaactggccttggtagaagcggatgaaaacaaagataaggacgaggataagacatccgataaagattccgataagaaaaaagaggataaggataagcctgtagcccccttgaagtttgatttggagaaccgcaaggaccggattattcgcctgaccgctaattcatcctcattgggagacgccgtactcgccccgaaaggagataaactatattattgcgccgctttcgagaaaggctttgatttatgggaacacgacttgaaggaaaagtccactaaattactgctcaagaatgtcggtcgaggcactctattcgccgataagaaagtagagaacctctatcttaccgccggcggtaaactgaaaaagatagagttgaaggatagcaaggaaaaaccgatcgctttcaaggccgagttcgcttatcgtccggcagaggagcgtgcttatatcttccaccacgcttggcgtcaagtcttggataagttctatgatccgacactccggggcatggattggaaagggtatgagaccgcttacgcccgtttccttccgcatatcaacaataattttgatttccaagagatgctttccgagctattgggcgagctgaacggctcccatacgggcgcccgttacaatccgggactaaccgggccggaaaccgccagcctaggcgctttcttcgataacgcatacacgggcgacggattgaagatcgaggaaatcatcgccaagggcccgctgacattggccggcagccagataaagaaaggctgtatcatcgagaagatagacggaacaccgataaagaaagacgccgattattatccactgctaagcggtaaagtcggtaagaaagtaatgctttctgtctatgatcctaccagcaaacagcgtttcgaggaacaggtaaaagcgatcagtaacggagagctatcgaacctcctttataaaagatggatcgagaattgccaagaaaccgtagataaattatcgaacgggcaaatcggatatgtacatgtgagaggtatgaacagcgagagtttccgcgaggtctattccgccttattaggccgttgccggaataagaaagccgtgatcgtggatacccgccataacggaggtggctggttgcatgatgatctggctaccttattgagcggcaaggagtatcagcgcttcgagccgcgcggacaatacatcggtagcgatccttacaataagtggaccaaaccgtcctgtgtcttgatctgcgaggataattactcgaacgctcatggtttcccttgggtttataagaccttaggtatcggcaagctgatcggcgccccggttccgggaaccatgacagccgtatggtgggaaacgcagatcgatccgaccttggtgttcggtatcccgcaagtaggcgtgaaagatatgcaaggcaattatctggaaaaccaacaattgcaaccggatgtagaggtgtacaatactcccgaggcgcagctctccggcgaggacacgcaattaaaaagagcggtagaagtgatgctgcaaactgtaaaatagcttttctaggcctcggaaatgacttttcaaccttgtaaaatgccttccgaggcctcggaaatgacttttcaaccttgtaaaatgctttccgaggcctagaaatgacctttcaaccttgtaaaatgccttccgaggcctcggaaacgacttttcaaccttgcaaaatgctttccgagacctcggaaacgacttttcaaccttgcaaaatgctttccgagatctcggaagcctctttcactcacatcgaacagaagaaagaaacgaaaaacggaaccgtgaagtccaccaagatcccgtgaaagatagagacaaagaccaaatcctttccacaataacgggtgataatcggcaatgtcgtatccatcgtagtagctcctcccgcgcagatcggagatagccttccgaaatatctaacgaacaacggagcgcccagcaaggcgaatatctcacggataatattagcgatcaaggcgatcgttcctaactccgccgccaattgcgcccccagcgtcggttcttttagctctgttatcaagatggaggataatgaataataggcgaaaccgcttccgaccgccaaacaatcgaacacactccatttggtaagagcaaggctgatcagggccgagaagctcaacgtcccgataatagtagccagaggcaccaataagagtttcggccgtatactcgataaaatatctttcagtttcttatcgcttcctatgctaatccctacttgaaacatcaagaggtaaagtacataaaccgttatatcattctcgataatgaccccgggcagataaccgctccatcccagcaagcaccccaaggcaaagaagcccacgacgatcaaactccctttcatccccggctcctttccttaaaaaagaaatgataaactccccacgccgccaagacgctacccaacgtaccggccgaagcaatcaacaaggcttgcccgcccaacgtcgtaagattattcacgatagactcattagcccctaccgaaattcccagcaggaacaaaagaagaagaatcgtataagaaataggcttaccgatcttttgcagcaattctactttacgaaagaaatacccgacggcaatgccgcagaacatgattccgattactgtaaacatccttttgtagtttttgccgcgaagttaacagaaactcacagtaccacaaagcggttacttcttcgttttcttgaatttcacgggaatctgcatacctccggcgtcggccattccctctaacttatttcctttctgggtcatagttaagtctacaggcgttccatccacataaaaagagctggtataggtatctcctttcgccttgatatcatttatctccaaggtactaccttgtatattcactttagcggtcaacttgccgttctcttgctttatctgaaaacttccatcttgatatccatacggagcgtcgggggcagagaaggaccaatcgcctacgagcttactgagatctgcggctttatcctgtgccgagatcgtgatacaaaacaaaaggcataaaagggtggtaaaggctttcttcatgttcgttcccataatcttatgaattaaatgagtaatagatttaaataacgttccaaatgtagtgattaattttcgatcttccgagatatgttctaatatacgagcatcaaattctttccccaaagggggtaatgcctcggcctcatgagatacgaaccaagccttatagggtaataagtcgggaggtaccaccgctgaggagaaaaactggcgtaattcccgctcttcctccacggatgtggcgcattcccaatatttatccagcaacttatttattcgttgatagtccatacacgatccataaacagattaccttaccgcataccgctccatcctttccttatttccggaatacgtttccctcaatgccagattacgcgctaccatcatgcaataggaaggtaagttctcaatgacaatccagctatcccggtcttcccaaaccttaagcagggcttcctgaacgatctgctcagacttctccacgtctccggtaatccggaaaacaacccggaaaaggttattcttcagcggcaatatctttgtcgtaaattcgtttgttcccatacttttttatctataagacgagccaagcccgaaaaaggttgcagattttaaaaggaaatttccaatattcccccaaagccattatctttgtgacagatgattgataattcgcttattacaaactaaatcaataataacagtgaaaagaacgatcttattttttcaggccgctcttgcctgcctgctggtaggatgcaagcaagcgccggagtcgccgcgactacaagatgaggtgaggtatgtagacccattcatcggaaccgggttccatggacacacattccccggagctacccgtccgtacgcgatggtacaactaagcccggatacccatatcttgggatgggacgcaagtagtggttaccattatgatgatgaccatatctacgggttcagccacacgcatctttctggtacgggtatcggcgatctgggtgacgtagctttattacctttctccggtggagattccatcaaaccagtagctaccttcaagaaagacactgagaaagcgacaccggggtattatgccgtacgcttggataactttggcatcaacgtggaattgacttctacggatcgtgtaggtttccacaaatatacatacgacaatcccaaagaacgtcgtgtcctgcttgacttagggcatatccttcaaccgaactggggacataagctgatcggtaaccaatatttacttgtaaacgactccacggtggaaggaaccgtgaagacacaaggttgggcgcatttccattctatgtcctatcggattactttctcggaaccgatcgagacggtataccaatacatcggggggaaattacgtaaagactccttgttcttacgcctaaatacggcagaagatttgaagttccattacaaattcgctgaaaaggcacaaccgctttatgtaaaagtagccttatccgtagtcgatccggaaggcgccgagaagaatctcgaggcagaattgcccggatgggatttcgataagacccgtgaggaatcaacgcatatttggaacgaggcgttaaacttgatccagatcgaggcagatccgaaagtcatggtcaatttctatacggcgctctaccataccatgatcgcccccttcgcttatcaagacgtggacgggcgttatttgggtatggacaagaaagtgcataccgccgaaccgggttacgtaaattattccgtattctccttgtgggatacgttccgtgcgcttcatccgttaatgacaatcattaatccggacttagcgactgattggggtaaggtactcgtgcaaggttataaagaaggtggaatattacccaaatggcctttagcctctagttatacaggttgtatggtaggatatccggccgtctcggtcctcgccgaccttgtagcgaaagatttagcggaaggtgatatgagcacgtgggcggaagccggcgcacgttcttccgtttaccgtgaggatcttgccgagaagttcaaaggaacccgtgagttggatctgatcacgatgcacccttactataaggagaaatatggtttcgtccccgccgactctgttcccgaatccgtatcgtggggattggagatggcatacgaggattggtgtatctcccaaatcgccaagaaggcaggtaatatagagttggcgaatgagtatgccaagaaagccgaatactacaaacgctatttagatcccgagacgaaaatgatgcgtccggtaatgggcgacggttctttccgtactccattcaaccctcgctattcttcgcatatgaaaagcgactataccgaagggaatgcctttcaatggagtttcttcgcaccacatgatatggataacttcatcgccgctatcggtggcaagaaagagctggaaacacgtttagacaccctgttcaccacctcttcccagattgacggggcggaagcctccggagatattaccggattgatcggccaatacgctcatggaaacgagccgagccaccatatggcctatctttataactggacagattctccatggaaagggcaagggtatttagattatatcatgcagaatttctacacgaatgaaccggatggtatcatcggtaatgaggattgcggacagatgtctgcttggtatgtcatgagcgccctaggtttctatcaggtaagtccgggtattccggtttacacattgggccgtccgatggtaaataaggcttctatgcacgtaaaaggcggtattttcgagatcgtggcgaccaacaatagtcccgccaataaatacgttaaagaagtcaagctaaacggtaaagtcctagagactcctttcatcagccactccgatatcataaatggaggtaagcttgagtttatcatgaccgatcaaccggtaaaataaattcatataaagaaacataaaaacaaagggcgaatcagtacactggttcgccctttatcttatatttgccctcaaacgattaaattgaaaagctatgttactcacaacaactaacacgatcgaaggaaaagaaattacccagtacttcggaatcgtatccggtgaaacgatcatcggagcgaatgtattcaaagatttcttcgcaggcatccgggatattgtcggaggacgtgcaggttcttacgagagtgtcttacgcgaagcgaaagaaacggccttgaaagaaatgagcgatcatgcggcacgaatgggcgcaaacgctgtaatcgccgtagatctagattatgagaccgtaggaggaagcggaagcatgctgatggttaccgccgccgggacagccgtacgctaccaataatccccaaaatgaaatactttggagccggattaagcgaatcacataaagaactaaaccgcattatccgtaaaccggaattaatagagcaaaccaaggagctctttcttgagattcatggaaaattacacctctctgtggtgtctggtaatgagagaaacgaggtcgatgagctagtcggagatttaagagaggatgaatatgccattatgcctacagcgaaagatgaaaccatcgcttgggtattatggcacatcagcagaattgaggatctgaccatgaatatattagttaacggggaaaagcagatcttcaatgaagactggcaaacccgaatgaattcccctatcagagacacaggaaatgccttatctgataaccagattattcagctaagcaaaagtctacgtattcaagaactcttagaatacaggaatgaagtaggacgaaaaagcagagaaatcatccgaaccttatctcccgatgatatacgtcgcaaaatcccaactcaaaggataagccggatattagaagaaggttgtatcacaaatcatgaagattcgatttggttgcttgatttctgggctaaaaaagatatagctggtattttattaatgcctcctaccagacatgtcatgttacatctaaatgactgttgtaaatggaagctagcaataagaggcagacatcattgaaaattaaacggctggtgtatataccaaaaaaaggagccaatctttcgactgactcctttcacctaagacggcggctacct
